United States Patent 10,724,096 (METHODS AND COMPOSITIONS FOR INHIBITING AND TREATING NEUROLOGICAL CONDITIONS) - sequence listing, part 135

SEQ ID NO: 2445 - DNA, 581663 bp, Homo sapiens
agattctgcatcttttaatgaaagataaaacaacaatataaacatacacaaatttacagagaagggatcaactttaatacatttggagtaaaaggtgtttcttctttaaatatggtataaaaataaatgcgagaaacattaacggagaatgtacagacaacagacgaagacatgagtttgtttctgactgtgacacattggtgaaatgaaactttctgtgcggaatttattgtttaataaatgtgaagccacatgtatacttattgatatatacttttttcttttacagttcttccagtttttgactgactgaattttcagtgaactgtgtgtctaactgaagctttgagagagagagagagagaaagaaggaaaaaaagaaaaggttttacttcacttgaacttgttaaaaaggaagagacacagatccagcatagtagaaggagaaagaaagcagacaacagtttggaatggaggcattgagacggaagagtccattggagatggaatgtacacacaaaaataacaatttaggtcctttgctcatgcaacatcttgttctaatgtcctctgctccaggtcacaacattgagctacaaagtgtgtgcagtgactccagtctgcattcatgctacaagatgatccgtttagtaagactgagcaaggcttgttaacctcttggacgtgagagatttcccctgagaaaatatataaaacaagagaaaagaaagaaaatcaagtacgatcactgaaaacctgcttagtagtagcaactatttactgtagctgatttttgtgcaaggtcaacactgaaccctttaagtccatcttagttcaaacctcatgaccaacctgccttcccccctccctccctccactgacacgtcaaacaaaactatcctccctccctccaccctcctacccctcccaaatccttcctccccactgcaaacagactgatggtttcacagcacagattagcaaatcataaaacatatccataaatgctccatcaaggcttagcaatgaagcaacacctaggttcccaactgattataaacatgttacaacaaatcttagtaagctgctctgaaagataatgtgagtgcattcttgttcaatggctgaaattaatgtcacatttataaatatctagaaatgtagaggatacgatttaattaaataaaatgcagtttttgagggtgtgattcatgaaactcaagattgagtctgttccctatcttacataataatggataaaaaggtgccaattatatatctgaagataaaagtctacttgttccctgtttctagctgttgatgtcttcctgttctttcctacctgacttcttccaaccctaatacaagaaaaaatctgttctattctgattccacaaatcatatgattacataaagcacatacttatgttttagaaatcttgtaagtcaacagtgttgctgttaatcacaagtactctagagagataagaaatttgagaccgggcgcagtggctcacgcctgtaatcccagcattttgggaggctgaggtgggcagatcacctgaggtcaggagttcgagaccagcctggccaacatggtgaaactccgtctctactaaaagtacaaaaataagccaggcgtggtggcgggcacctgtaatcccagctactcaggagaatcacttgaacccaggacgcggaggttgcagtgggctgagatcgcgccactacactccagcctgggtgacaagagcgagactctgtctcaaaaaaaaaaatagaaatttgaaacgtttgatcggaatgcaaaactgctggttttcatttcatgtcttattttatatgttctattataaaattatgtgggccagttatttaatgaatttttgtacatctcagaagataagtaaaaattaaaaaattggaaacatatattttagtaataaatcacagtcatagcaatactcttgatttgctacctaatgtggctcagttttagaaaggggtcagcggtgatgggagatacatcatcactcatggccattgccttagtctgtttgggctgctataacagaaaacgatagactaagtggcttataaacaacagaaatttatttcttataggactgggaagtccaagatctagacacttatagattctttgtctagtgagggccttctccttggttcatcaatggtgcattctcgttgtgtcctcagataatggaagaaggaaataagctccctgggacctatctgataaaggctcctgttcataagggcttcaccttcatgatctaatgaccttccaaaggccctaactcctaataccatcaccttcatgatctaatgaccttccaaaggccctgactcctaataccatcaccttcatgatctaatgaccttccaaaggccctgactcctaataccatcaccttcatgatctaatgaccttccaaaggccctgactcctaataccatcaccttcatgatctaatgaccttccaaaggccctggctcctaataccatcaccttcatgatctaatgaccttccaaaggccctgactcctaataccatcaccttcatgatctaatgaccttccaaaggccctggctcctaataccatcaccttcatgatctaatgaccttccaaaggccctggctcctaataccatcaccttcatgatctaatgaccttccaaaggccctggctcctgataccatcacccttgagattaggatttaacatgtgaacttgagcgggaagggatcacaaatattcagttcatagcagccacatttttggaaaaagacaatatgtttaagaaaagattaataattccataatcaacctgtctttacacaccatataattactgataagggcccttttgctgatatgaacagcagcaatgaaaatcatgcaccattttctcttaattttttcttaattgggaaaaagggtccacaacttagctttcagcatctgagagtagaagatattaaagtggtttttgttttgttttgtttttttgagacggagtctcactccgtcgtcaggctgaagtgcagtggcgaaatctcggctcactgcaacctgcacctcccggattcaagcaatcctcctgcctcagcctccagagtagctgtaactacaggcacctgccaccacgcctggctaatttttgttatttttagtagagatggggtttcaccatgttggccaggatggtctcgatctcttgaccttgtgatccacccgccttggcctcccaaagtgctgggattacaggcacaagccactgcgcccggctgatatcaaagtttaatgctggcatttcccactaggcttatgtttattcactttatgggagaaacaacaataaaagagaaaacagtttattaacaacagaccctgctttataaataaaatatgcactcctgcctgctctggtctgtctgtccccctcaaagctcacatgttgaaagcttactccccagtgtgatgctattaggaggtgggggctttgcgaagtgaccatgtatgagggtgaagctctcattaatgggattagtgttctttgtgtgtgtgtgtgtgtgtgtgtgtgtgtgtgtgtgtgacagtctcactctgttgcccagactggagtgcaatggcgcaatctcgggtcactgcaacctccgcctccaaaggcccctacctttggagggcctcaaattgcttgagttgctgggttcaagcgattctcctacctcagcctcctgagtagctgggattacaggcatgcaccaccacgcccggctaattttgtacttttagtagggccagcttttgccattttggccagcctggtcccaaactcctgacctcaggtgatccacctgccttggcctcccaaagtgctgggataagaggcatgaaccactgcgtcaggcctagtgctcttataaaagaggccgaaggaagcttgtttgcccctcccaccaggtgaggacacagtaggaagatggctgtctatgaaccaggaagggggccctcatcggacactgaatctgccagcatcttgatcttggacttctcagcttctagaactgtgagagataaatttattttgcttataagctacccacccagtttgtggcattttgttatagctgactataacggactgaaatgctgcctccacttctatgcctatttcctcatctgtaaaatgaggataataatagtacttattttcaaattttgttgtgaagaatgatacaagtaaattgcttaaaattatttatggatcattttgtgcactcagtttacgttggctattacctcattatactatcattataattattaacactatcattatatgctctcttcattaagatacccaaacccagagtcactattctgactctaaaaggacagaaagttataaattaaaagctaaaatcatactgcttttccaccccaatcctgggcaataagctaatcaaatgatgttgaaataaaaaagattcagttcttaaatacaatgccatttcctgtgtttactactgtagtctctgtgctatgaatagaattgtatacacatgtgcatatatacctattctgagactgaacaatttatatttaaaaagtgcttacttggctgggcatggtggctcatgcttgtaatcccagctctttgggaggccgaggcgggtggatcacttgaggccaggagttcaagaccagcctggccaacatggtgaaaccccatctcttctaaaaatacaaaaatcagctgggtgtggcggggcacacctgtagtcccagctactcgggaggtgggagaatcatttgaatctgggaggcggaggttgcagtgagccaagataggccactgtactccagcctgggctacagagtgagactctgtctcaaaaaaaaaaaaaaaaaaaaaaaaaagtgcttcctctttgtgggatgaaggaaggtacacatcagtacacgttgttgaggcacaggaatgaattcttatatagtagaagactggggaaagatgctgatataaaactgtttcttttaaaactacagattaatgtgatttggttcaaaattctgggaagaagaatgggccgggcgcggtggctgacgcctgtaatctcagcactttgggagagcaaggcaggtggatcatgaggtcaagagatcgagactatcctggccaacatgttgaaaccccatctctactaaaaatacaaaaattagctgggcgtggtggtgcgtgcctgtagtcccagctactaaggaggccgaggcaggagaatcgcttgaatccgggaggtggaggttgcagtgagtcgagatcgcaccactgcactccaacctgggtgacagagcgagactctgtctcaaaaaaaaaaaaaaaaaaagagtgaaatagttacattgaaattggaagccatttgaaactcagatacagtcatttttttatttgaacaatgacatctactgttgtctttatcaatttataaaaaaaaaaaaacatggttctctttctatggttttgtttttattttttcaaatatcctcaaatcctcaaagctactagtacttggcctgatatggacttcattaaaaattggatgatacaagttaagcccgacaaactcttgtcccaggaaataattaaaaaatactttttcatagcagcccagagagaaatacaggcccacagtaaacctggggctttgtgatattagcataacaatgggcaaaaatgagaaaacatacaggtgtattttaacaacaaaactctgtgtggaccaggcgaggtggctcaggcctgtaacccccgcactttgggaggccaaggctggcggatcacctgaggtcaggagttcgagaccagtctggccaacatggtgaaaccccatctctactaaagatacaaaaattagccaggtgtggtggcaggtgcctgcaatctcaactactcaggaggctgaggcagggagaatcgcttgaacccaggaggcggaggttgcagtgaggtgagattgcgccactgcactcatcctgggtgacagagcgagactctgtctcaacaaacaaacaaacaaaacctctgtgtgtggtatagatttatcaaatgtgcaataaggatatttgttttgtatattgagacaactaaaaggcaaacttgggtacaactaacagttaacagatcttgggctgggtgtggtggcccacgcctgtaatcccagcactttgggaggccgaggcaggtggatcacttgaggtcagaagttcaagaccagcctggttaacatagtgaaaccctgtctctactaaatatacaaaaattagctgggcatggtggcggtcacctgtaatcccagctactcgggaggctgaggcaggagaatcacctgaacctgggaggaggaggttgcagtgagctgagatcgcgccattgtactccagcctgggcaatagagtgagactccgtctcaaaaaaaaaaaaagagatcttaagtgcagcactgaggtcaaagcagacagcatggatgcccaataggccatctggattggaagatttacacttggatctatttgtaaaccatgtgcaaatcctgccttattcacatagtggaaaggaaaatgcataagccctactctagtgcacaaagaaatgattgtgtgtatacttttggttgctcactcctccactgcaatgtattaagttaaaaagaacacgatcacttccagggaagtacacgtggtacggtatttgcatgtcagccattttggaacaatcattttcagtgcagttccttggatgctgtatggaaccagctcctgccaatgatcttttcccaatttttccaaattgaagaatctgagaaatggtttttaaaaactattttttaaatttttcgagacagggtcttgctctatcacccaggtcagagtgcagtggtgtgaccatgacacactgcagcttcgacctcccaggctcaagcgatcctcctgcctcagcctcccgagtaggtgagaccacaggtgtgcaccaccacacctcgctgattttttatttttagtagagatgaggtctcattatgtcatccagtctgatctcaaactcctgggctcaagcgatcctcccagctcagtctcccaaagtgctaggattacaggtatgagacactgtgcccgaccaaatatgagacatttttatagctaagttttaaagtcttaattccagaaatgaaaagggctaacaaaccctatcaatggcacttttaaaaaacgaaattgcttacaataattctatgcgaataatacttatttttaacccaatgattacatatgtgttatgtgatttaaactcttcctgtcagattctaaaggaaacagattatagtggaaacaaatctatagagaaagacaaatatactcagaacataacaaaaactcaagatcctgtgagattttgtaatatctggttaatggaaatatgctagaaaaagcagcatataatcagtttcaggacaaaataaacctgagacttcagctggcacgtaagtgaacagagagcatcatcctagtctataatacaataattacataaacaaagagagttctctagtgtgtcacaataaaacttcccctcaaccaaaccaattcctttctgtcctaaatggtttgcagagattttgttataattagggacaacactctcaaaacaaaaataacaacctatgtatttgtccttaacttttccaagtgagctatcaaaggtataaattttaactgactttaaaaacatcattcttggcctgggcacagtggctcatgcttgtaaacatagtaccttgggagactgaggtggatggatcacttgcagtcatgagtttgagaccagcacggccaacatggcaaaaccccatctctactttaaaaaaaaaaaaaaagcagggcatggtggtgcgtgcctgtaatcccagctacccaggaggctgagacaggagaattgtttgaacccaggagacagaggttgcagtgagccgagattgcgccactgcactccagtctgggtgacggagcgagactctgtctcaaaaaaaataaaaaataaaaaataaaaaaaaatcgttcttggtcttaaagtaataacagaaagttgatggtaaggagccctgagtcagtaggaattgatgaaggccaggctcttagctatagcctgagagcctggggcattagggagatggaagcaacttcctacattcttctcctgcaatcccttcttcacaaaggaaatagagagaagctatgtttgctttagttactaagcccacttattttattgctgtcataaaaacacacagaatggccaggtgcggtgattcatgcctgtaatctcagcactttgggaggccgaggtgggcggatcacctgaggtcaggagtttaagaccagcctggccaacatggtgaaaccctgtctctactaaaaaaaaaaaaaaaaaaaaaaaaatagccgagtatcgtggcaggtgcctgtaatcccagctactcgggaggctgaggcaagataatcacttgaacccgggaggtggaggttgcagtgagccaagattgtgccattgcactgcagcctgggctacaaaagcgaaactctgtctcgaaaaaaaaacaaaaaaacaaaacaaaacaaaaaaacacagtagtcttttctagtatacaggacactgaagagattgagcagaaataaaggggcagatttttaaagggtggctatgaaacagattacagagaagagtagaaagttatcaacatcttttagattttttttgaggccgggtacgatgtctcacgcctgtaatcccagcactctgggaggtagaggcgggcagatcacgaggtcaggagattgagaccatcctggctaacacagtgaaacctcgtctctacaaaaaaaaaatacaaaaagaattagccgggcgtggtggcgggcgcctgtagtcccagctactcaggaggctgaggcaggagaatggcgtgaacccgggaggcggagcttgcagtgaaccaagattgctccactgcgctccagcctgggcaacagaataagactccgcctcaaaaaaaaaaagatttttttttttttgaaaaaaaatttaacctccattttcgctatccttttgcaattcctgcttgtttgtctccagccactgcctccgagtctctcccatatgttgctgtagactgggatggatattcttgagtgccttgtaggctgcagagactatggagaggcactggggataagaaaggtaaaatcttatcgttgcccttccactggtttatgtgatccaactgtctcaccagatgctcaaccccacagctatgttaataaaaagaactgaccatatggtggtaaaatgagatgctattggaccagagatagggaatgtttttaggagagtctgagctaaaggatgttatctgtttattattttactctcatgttgaaaaatgccttttccacttattgaaccagggataggcagtgctcttagcagagtctaaactaagggatgctagatgtttgttattttactctcatgttgaaaattcccgtttcacttataaatataaacatctttgcctggatttccaaatccttcactacctgggttccgtggcctttcagactctttactgttacccacgaagtggttctttggctggcccttgtgcctgctgctctctccgctggtcacctgtttgtgcatgtacctgttcagaccctatccactcttcaaagatgaacttcctatctatgtccttgctaaagctttctaactatccctaaactcctccggttccctctttgaattcttcttgctggtagaacctgcattagcacttttatatgccttcttacgtgattttgtaagtcatctggcctgatgaagtgataacggacagctgttaaacattaatattatagcagtctccaaataagtagttgattatttgcaagagctgagctccttggctgcaaatctcattaagggaataaacttctagaaatcagggtaatgagattccaaggtcttgggaaaattaacttttaatttgggggaggagagacatggtggagagagggatgggggtcactggtcacaccctaaatgttaacagattgactaatagaatcagaatattttcaagtaggcaggtgctaagaaggaattcaagctaggctaggtgttagggaagctcttgcacaatttaaatgaaatcagttcttccaggtaaacttacaagtgagtttgctgaaacatagtgaataatttttataaaactgtggaggtgggtgagttcctagaatgttaaagataagctcgaattcttgagaattaagatggcaaggacaagaggaagaggattctgtagttagttttgaaactgtcatatttaatgttgaatgctgaaaaatattctagtactacgtactaaaaagagatagcttatgaacacatatacatttaagtactggtcactagcttcctaagagaattgagaaagaataagtatagccaaatactttcattttcttaaaatatttttccataataaaaccagtatgtgttcactaaagaaaatgaagaaaacatagaaaaaagagaagaaataaatattacttgaaatatgatcatttacattctattatgtccttctacctttttatacacagatacatgtttaaaattttttttacaaaactgaaattatactgtgcatggtactatgtcatattctgaataacgtgtgtattaaagagattacattttgttcaattacccatgttatggatgtttcttcaaaaataatgttgttttaccaactaaatgcattagttggtaaggaaatcaatttagagagatgcaaccaacatttagaaaaaaattaagtacagaatacattttaaaaatcagattgcattgcacataagggaatgtattgttatttcagttctatgtacatataaacacacacaaatacagtttatacagtaaccatatatatgtacacacacacatatacaaatacgcacaaacacatgtatgtgtcgatcaaatgtggctactctgggcacactgcctatggattagccctgctctgcaaggaacaatagaaaaattaatattttttaaaaaatgtgtcaaatatgggtatcattaaaagaaacaaaagccaatgctttaaaatataatttttaacattcgtataacattccaacagtagatatgtcttgatacagttaagaaattcacaattgttgtactttcagattgtgttctatatttgacaattatataatgcaacaaatattttttatatgtgggaacacctgggttttttttaggattaaactactagaacttgaattactgattcaaagtgagagatttttgaccttctggcacattctgtcaaattctattcgacaaaagtgatagcaattcagacttttatgagcactgtatgagatcacctattttcttaacccctttctgatactagatgttatcatattaacaaaacacatctatttggaggaaaaagtgattgtgctgctttctgaattttacttgggtattaataacaataggttttcttttttgttttctcacatatcaatgtactgtttgtatttcttttgttaaaattgcctaagtccctccctcattcttctaatggtgtgttgctcttacgacattatatgtttgcaaggagctccctgtagaccctgtattacattttggtctgtcatagagatgctcctttattcattttaaaaaggagtttaccagatttgagcacaggaacttgctttaaacaaaagaccttcggctacgtaaggcacgcagcaggatttgcagtatctctgtgattgaaaaagagaaagatgtgcttcataactaaacaaacaatgaccttcaaagtgtgctattagggcagtggaattctgtcttcctccctgttccttatggtattttaatcagtaatttgaaagattaaactgatgaaattctgataaaatgtatgtatgatctacatatgataaccttggtttaaagactgagtaacaaagaaatacttcaaaaaattatgtaaagctttaaaaatgagctataactcacaagataaatttagtggaaagaagggtaaagagccaacatacactaaagtgaataagtaaacaatgaacgaagaaacctagcagcaaaacacaaaattagggacatgtaatctcagcacatgagaaaaaaaatccaatttttaaagtattttattttaagccccaaatgacattacatgttgctctggttgggggaagttgatgcaattttcaggttagattttaaaagttataatatatgctggctgggccatatctcaaatattgtgtttggttacgattacgaggcctattgatgaactggaacacatgtacaaagtgagcaaacagcaggatgaaagaacaggaaattattaaatgggacaacattagaagctcactttcccattttaagtgtcactcagatttaatttgctagcaacatttaagacatctttatcaagtgtttttgtgttcagcttaattttcacagaagtatctttttctttttatactcaaatttcgacaggtttattttaataaagtacttaaatgcagtatgccatatatttaattataaacagctatgggaacaaatggaacaaaacaaacaaaaatggactcttatactatacagttcaatgggtggttgcagaaatgtgaggacctaattggacagcagcatctcagctgtgacatttgtggctcttgacattcactgtggagaaagtgaagagcattggtacatctagggcagtggttttcaaagtgtggtcttaaaatcagcagcatcagcatcactgagaattggttaaacatgaaaacacttgaattggatccatcagaaaatgacttacgtagactttctgaaagatggagtccagcaatctgtgttatcatgagcactccaggtgattctgatgcgtctcaagtgagaactgcggatgtttagtaaggagagatcagctgggaatacttctatttgtgtgatgatttttaaactgtatggttttgggatgcttgtaaccaatgcggagcagagacaaagacagaataattctaatgtaatcagagatgaggttacaaatctgcatttgccaagcccctggtgatttttgaggtatggatagttggactacacttagaaaaataatgaagtaggcagggtgtggtggttcacgcctgtaatcccagcactttgggaggccaaggtgggtggatcacttgaggtcaggcatttgagaccagccttgccaacatggtgaaacctcctctctactaaaaatacaaaaattagccaagtgtggtggcgcattgttgtgggaaatcagggaccctgaatggagggaccggctgaagccatggcagaagaacataaattgtgaagatttcatggacatttattagttccccaaattaatacttttataatttcttatgcctgtctttactgcaatctctgaacataaattgtgaagatttcatggacacttaccacttccccaatcaatacccttgtgatttcctatgcctgtctttactttaatctcttaatcccgtcatcttcataagctgaggaggatgtatgtcgcctcaggaccatgtgatgattgcgttaactgtacaaattgttgtagagcatgtgtgtttgaacaatatgaaatctgggcaccttgagaaaagaacaggataacagcaatgttcagggaacaagagagatcaccttaaactctgactgctggtgagccaggcagaacagagccatatttctcttctttcaaaagcaaatgggagaaatatcgctgaattctttttctcagcaaggaacatccctgagaaacagaatgtgtccctgaggggaggcctctgaaatggccgctttggggatggctatcttttacggtcgtagctgtgggatgaaataagccctggtctcctgtagcgctcccaggcttattaggatgaggaaattactgcctaataaattttggtcagaccagttgtctgctctcaaaccctgtttcctgataagatgttatcagtgacaatgcctgcccaaaacttcattagcaattttaatttcaccccggtcctgtggtcctgtgatctcgccctgcctccatttaccttgtgatatcttattaccttgtgaagcatgtgatctctgtgacccacaccctattcatacactccctccccttttgaaaatcactaataaaaacttgctggttttgcggcttgtggggcatcacggaacctgccgacatgtgatatctcccccagtcacccagctttaaaatttctctcttttgtactctgtccctttatttctcagaccagctgacacttagggaaaatagaaaagaacctatgtgaaatatcgggggtgaatttcgcccaatagcgcatgcctgtaatccaagctatttgggaggctgaagcaggagaatcacttcagctggggaggtggaagttgcagggagccgaaatcacgccactgcactccatcctgggtaacagactgagactctgtctcaaaaaacaaaaacaaaacaaaacaaaacaaaaacaaaaaggaaagaaataaaaaaataaaatgaagtagagttttctttttttaatttataaatttgttttttatagagaccagatctattttgttgcccaggctgatcttgaactcctggccttaagtgatccccacaaccccttgcctcagcctcccaaagtgctgggattacaggcacaagccactgtgcccagccaatgtagagattttaactaagggaaagaaaaagaaaacttgagggaggtgatgtaaatcacaccttcaagcaattcactagttgtcatctagaggaagtgcttgtattactctgcagtggcttcaggaaatagaactaggattaatagctggaagttacagaaaagtggattagggaagggatttctaagagatggaatggtctgctgtctacgggtaccacatctcagatactcaggagctgccaaatgctgaatacccatttgtcactgagcctacagaaaagattcttgcaatgggctggggattggacccagggaaatagggacctctaagttcctttcaattctgaaactgcaaaaattttatcattccccagatctcctgaaagtaccttgaagatttacattttataatcagaaaagagaaagctctcccaataatcttttctatctcatgttaggaatatattcttgttagatattaatatgcctatttcaggtgaacagtgttgataatagggacttgtttttctcctttgtagtaactgagcccatgtctattgggtaatttggctgatgaaatagatgaaaaacttctttaataccaaaataaaatctgcatgactcaaagaggcaaaaaactgatgatgaactttttttcccccaggaataatagagcattctagagaatgtgctttaaatttccaacaactgccacagcctattttagtaatggcttctgctggttgaaattacaggaataagtggtgtatttaggattgtccaatgtgtgttcctattattattaggtactggccattgacaaaaacaatgacaacagccatcaaaatatggtgcacaatgaagagggcaggagattttgcccaatctgggcttgtgtacagtatcagccaaaaacatacgaaaaatttaccaaggtgtctgtagatatacacataatatatccatgcttatagatggatgcaatttagataaagatgtctaatgtattgctattttaaattgtctattttagtgtcattgctttctgggtactagcaaaaattatggaaaagaaaaaattacaaccacagcttgtcatcagtataaaaatggctttcttttctgaaagaggtttcataaaagaatgctaatgagtatatatgaagctacatgtgtctttagactaagcaagagaaaaggattttgaaagagatgacttgttgatgacccagggctgtctagtaagtggcctcacaactagaaataattaacatatgactccacttttggtggaaattaaatttggacaccataataaacccaaactttacatcaacaacttccattcatctttttcctagatacttaaaacaaatttataaaaataatgtgcaaatattaccctttagaccgttgatggaattctgcttaactctttttcattctatttgatgctgtttaattcaatgacataaattgagattgagagttgaccatctgcaaggtactgtgccaaatgttgaaatgctaagattacattacatagaagatataagtcctatatctccttgctttactgagctacaattttgtaccataatatgagattcagatcattttgaataataattcaagttcaaatatcaccaaataaaataaaagtgataatgcaacataatgagctaatggtcatatataacatgattttaaagtgagacagtgtgacatttatttttctgctgtcaagtcttccagtaaacttggttcaaaaatgttctaaaaagtttattggtgctacaagtcttcttcttccttcatttcttctattttgccacccaagtttttgttatcatctaatgtgcagatgactacagtagctgctgatgctgcaaacacatcctcctatctctagattctcctagcttgccctcatctgctgtgtagatgatgatggcccacgtgtagatccagagcacaggatatgttcttgattaccttcttctgtactctgcttctctcactggaaacctccacagtagtccctgcccgaatttgccttcttcagaccctctttcttgtgccacctttgctctgtctctctctctcctgcagggccccactgtttagcaggcaggtctcttgctaggccttaactcttcctctccctgcctactctgcactgttttaagagaagctatcatgatttatattaaggaagttcgtggaaagccaaatctgttcactgaacagttaacttgcatgagcagaatgaaccaactcaggtgcaactgttagtagtatctccaaagtagtaatttgtgttcatatctgtccttttgcaaagtataagcttcctatgagcagaggctttgtcttatctatccattctcagaacaaattgcctggcccacagtaggttcccaataactgttttgttgttgttgttggatataagaatctagtagtgcttgaatacatgggtgctcttggtttgtaaacttatcatacagagcccccaggatggtctctggctgaagcctcatagctactggcataaacccaagacttcatattcattggaacacaatactttgggaaatgctgtagaaacttctgcccctggcatatgtagcagcaggggtgacatttcccactgtggggagtgtctactcagcagccccacagcattccttaggaacccccagggctgtatcggacactctgacaaaaacccatgatacaattcagagctcacagaacttgagcagcaacttaagaactaacgatgctgccaggggaaaatgaagatatattgtctgaactcaattaggctacaaggtctgatacattgcacaccaatcgatttacatcatgctgcagggaaactaaaattgttttctcaggcaagttatcatcaccgccagtttcaataaaataagatggatagccatatctgccaactacaaaatgacaaatgagatggtttcaggtccacagcagaagaaagacgagaaaatagttcatctttgagcagacacatttcatatgcttgctggtaatatctatggtggggaaactcaatggtcagtttataaattattttcactgaaggtgtagtaggaatatatatatatatatatatatatattttttttttttttttgagacagagtcttgcactgtcgcccaggctggagggcagtggcatgatcttggctcactgcaagctccaccttcccggttcacgccattctcctgcctcagcctcccgagtagctgggactacaggtgtccgccaccatggccagttaatttttttttgtattgttagtagagacggggtttcaccgtgttagccaggatggtctcgatctcctgaccttgtgatcagtccgcctcagcctcccaaagtgctgggattacaggcgtgagccaccgtgcccagccatagtaggaatttttaagcgtagtttacctatattagtgtatctataatcccaagcaacagaatccatagcactcaaccctaaaataatatgcacaaaggctttctttaaggtaaattcacagggcagagatgtaaaatcaaaaccttccttctcgtaggttccaagtctgcttgtgtcctatgatgagtgttttgtgaagcagataatctgcctcattatgatgggtgtttgtgtcagttgaggatctgactcactctgtggagctcttaccatgcctacaacttcattaatatatatataatctagaaaaagaactttctgaatactctaaggcttgtctctactttattgtggtagagattgatatcaagggaagtgaaagtaaggacagccaagctgtcttttttaaccacaaagagtatcacataacctgacacttagtcaaaacttactacctgttgatgaatgaatgatttagaaactagaataatggtatataaaaacaatgatatcaatgtagcagatgcgtggatcccaggccaccaggtcaattttctctgttgggattatttatggggaacaaatccaatggcaagtttatatgttttctttttatttgtcctaggaccctttccaaaatagcctatttacactaatgtgcatgtaggtccaatcagtaaagtccagagtgttcagccaggagggacatgactcaatcccgaacagaaccaaggtccatcccaaacgtgccaggaatgggcagctgagggactgcccaagtagatttgacactgtactgcactgctcctaccctggctccatagctgggctggggctgtgattcccagacgtggcacctgtattattcacaggtttacactgtatgcagaggggagttcccagattatagttttatacgttttataggttattagaatatggagggaaatctcacactagattttacatttaataaaatccaggtaaggctgggcgtggtggctcatgcttgtaatcccagcactttgggaggccgaggcaggcggatcacctgaggtcgggagttcgagaccagcctgaccaccatggagaaaccccgtctctactaaaaatacaaaaaaattagctgggcctggtggcacatgcctgtaatcccagttatttggaggctgaggcaggagaatcgcttgaacctgggaggcggaggttgcagtgagccgagatcacaccattgccctccagcctggacaacaagagcaaaactctgtctcaaacaaacaaataaacaaaaaaacccaccaccaccaacaaaaatcaaaccaagttaaaaatcatttgaccagggactaaaaagtatccttcaagttttcaacagtgtcttaaaaaaaacaatatgtttcccggaaagtagctacagttcttcactgactgaagactaattggtggtggaggtctgtcattaatgtgtaacacactggttttggaaatcaggaatacaacatctgattcccaccttccagaataagttatttttccctctagtgtatgctcttgcatgaaggaaaaaataaagatacaaaagagataaaaagagataaatggatacctcttcccttgtaaatttacattccatttaaccaagcagttcaattttttatgaaaagaaaatcaatatataactttgattttattgtactttgacctataaaagcaatgaataataaataagcaacaacccaaacgtccattaatagatgatcagaaaaattacagggcatatccattcaaaagaattttgcatggttaataaatagaatcatgtagaaaaatagtcaattatttggaagacatttacaatgcattttaagtgaataaagaatgtttcaaaagaatatttaaatataattcaaattcttaagtatttatatttatttgtgcaaaatgctaattggagctgtgtctgggtagagagggtcatctagaggtgaagaaactgaggttcagcagtttaaatgattttttcttttattgttattataattattattatttttgcagagacggggtcttgccatgttgcccaggtggttcttgaactcttggcctagagccacgttcccgcctcagccccacaaagtgctgagattacaggcatgagccactgcacccggccttaaatgattttttaaaattcacatggctagaatatataggactaggtttcaaacctaaatagaaacacatcaaattccttggcccaggctctttttaccatgttaccacttatatataatctgcataaggctgtattaaccagtaattccacagtgggcttagataaatcatttaattttatttaatcaaaataacattctaaaggaactaagtgttgtatcttctttgttttctatttcaaataagaggatttacatttacatttgctcctatcaacatttaaacaattgagttacagagttaaaaacagatttcggctgggcacagtggctcacacctgtaatcccagtagtttgggaagctgaggtgggcagatcacttgaggtcaggagtccaagaccagcctgcccaacatggtgaaaccccatctctactaaaatacaaaaaattagccgggagtgttggcgggtgcctgtagtcccagctacttaggaggttgaggcaggagaattgtttgaaccatggaggtagaggttgcagtgagccgagatcgtgccactgcactgcagcttgggtgacagagtgaaattgtgtctcaacaacaacaacaataacaacaaacagatttgatcctaaagatcaactgatttcagggccaacccactcctgttaaatttctctcacggagtctccacaacttctggtcattccttgcagtccccagagcacagttaggagctcaatccaccagcacaaatacaccaggacagagagaacgggatagccaaggaggcatcatcttttttctattgattcttttaaagtctctacagataattgtcttcattaagatagagtgaaaatattttcaaaaagagataagattaggtgactccctgggtgttcaacatcaatactttctaatattcatttttacttttctacttttgtagcccagagccaggctgatttaatttccacttcacacaaagacaaaaccagtgtgttacacattaatgacagacctccacaaccaattagtcttcagtcagtgaagaactgtagctactttccgggaaactgatattgttcacacaaagacaagacagaaggtgagtcacacagctggcacttgattatgaatcttgattgaaggtgtggctgatcagtcatcctaccctgtttttcctttgttttctatctgtccctccttaatgtttgcatagcagacagatgctatggtttttcttatcttatcatgttatcttttcttattttttcagacagagtttctcttttgtcacccaggttggagtgcaatggcatgatctctgctcactgcaacatctgcctcctgagttcaagcaattttcctgcctcagtatcccaagtagctgggattacaggtgtgcaccaccacgcccggctaatttttgtatttttagtagagacaggctttcaccatgttggccaggctggtcttgaactcctgacctcaggtgatccacccgcctcggcctctcaaagtgctgggattacaggcatgagccaccatgcccagcagatgctatgatattttaatggctgaaaaagtggtgtcagatttgatgatggtgatgaagaaaataattttcataattcttaaagcatatgaacctttttgaaagagaataaagtcaacttaataacatttaaaggtatgagaggacatagtaacccttggaagaccaaccttaagagacttctctgatagcaagaaaaataaagaaataaaagagtaaacaagacatgaaaaggagctttcttgagacaacaaaccccaatgcgggcattacacaaatgtgagttatttttctcctacccattttgggattaatgaaaagaataagaataatctatgaagagtaatgaatttaaagtaaaagaaaaagcttgcttcgagttccagctctaatgctcaacagctggaagatattggtgaaggtgccctcacctcactatttccccatttttttgtctgtgaaaaaaggtgatacctgcctgactacctcccaggattgttgtgcatgcaaacaatgaccaaaacaacaacaaaacacacaaaaaggagtctatattttttggaaaattgaaagtgcaatgcaatcctcagctgtttattataatttttctctaaagtgctagtaagtatttatgaatctgggtaactaacaaaaactcccctgcaaaagctggctagcaaaatatttttgtctctggggtgaaacaaaaacaacaatgccatttttctaaccttggttataaaaaccctaggctggaacatgtaaatcaacttacaaaaataggcacgcattggaaatggactcagactggggaggtgggtatcatcaggtggcaaggtttatttattttttgtcagttgggagaatgtcaaagagcagggtggatccgtggaaatagcactggggaacaaaatacatttggagtcagtcccagctccttccctaactatgtgactctgggcaaattatgcacctcctttgaccctttaaatttcttacctacaaaatgggtaaaataatggctataataatatctaccttacagggccagcatatggattaaattagataatattataaagcgcccagtgcagagcctggtacatggcagatattcaatgaatgtgagtttttccccattattttcctagactacatatttgtttactattttcccctattccatttctttcttggatactgttgaccttgtagcctccctgtatgtaccagagcaacctgtgtagaggattcctttaaaatatttacataaattccatctttactccagtaagtctatctgattataataaaatcactcattctttatcttccattaaattattttattgatcctataaaggtgtctcataaaatttagtatgtaaagatctaagatgcttgatacagctgccgaccatgaagttataaaatacggaacactaaaccaaggggaaattcagagaaccttttaatttccttactccatttcttcagaataacacccaaataaaggtattaaataaaaaagattgcattttattttcctggatggaaaaggattaacactaagcaacagtgtctgaaagttattattatggtttgtgtgtgtgtgtgtgtgtgtgtgtgtctatgtttgtgtgtgtgtgtgtgtgtgtgtgtggatggtattcaacttcttttccttcagtaattccagttgttttttttttttccacttctctttaagaaggtggttgctcttcttggtctagtgaaatcctgcaaattcagttaaatgtaacttctgggatttctcagattacatatgggccctccctcctcaccctaacacccagtagaaattgtttatctttcccttgtacatcctaacattttgtctataccattgggtacctttgagatcaagctctaccatggatatccaaccttttggcttccctaggccacattgcaagaagaattatcttgggccacacataaaatacactaacactaatgacgaataatcttaaaaaaaaggtctgtgcataatttttataacatctaccaccacagataagcaaaaatgtccttgcattcaaagggttggacatggctgcaagtctatactttctacatggtcccaagacatagcacatggtttagaatagaggtggcaattgtgtgaattttgattgaaggtgtggatgatcagtcctcccttccccttgtttcctgttggccctttcttaaagtttgcagtgtgtgaccatatggtactattttaagagtttgagaagtgggttagatatgatgttggaagaaggacaaccatttgacttcccctttccatcttccccaggttacatcactattttaaattatatcacagaaatttccattgtaatttcaagaacagtatattctgtcagcattacgtttgaaaaggattaacttgaaatgcttcttaaacaatacacagagtacctcacattatctgatagtcactttctccagcaaaatcttggagaattgtttgacattgtctttattgccccatggtgacttatgaggcatgcttcagaaaattctgtattaaagaacagaggttccaatagtgccagccaaaatttcataaaatttatttacaatgtgattaattcctggagtccatcattctccatccctttaattcatgcaatcacattgaatgttcacagtatatattactgttcaaattctttcaaatactctgtgtaccgttgcaatggtaattcacaagtagaaatgagtaacattccccaccacaaggatccttgaaggaaactgaaaacaaaagccattatctttgttgaatccagtttgctcacatttcaacacacataactccactgaactggccatcacagcaaaagccacaacacacacacacacagcagcatggagctaaaccacacaactcaacagacaatgcagacaaacttgagtataaaccaagatttttctacctcttttcataacaggttagtgctggccctcagtgttggtgtacagtttttatggcatgggaaaatagggatgtttctgccctataaaaataaatgtgttgaaggctttagtttgagcttacacaatgtcagaaagttccaaaggcactggcacaatacaaaaaaaagaatcttacaaacaaatatatatcatcaaaacacatggcaagatactaagaaaacactggtaggaaaactactggtttctcaggtgatttatgcaacagttttcaacaccttcctgaaaaataaggaataagaaaggcaggctagtgggtctctggtggggcatatcttgtcaccaaccaccactcatataaaatctttaattttaaactgctcagtagatcattttctctctgcagaagtaaaacgcatagaaccctcattgttcttaacattttaagcctcaggaagggctaagggaaagagcatagaaatacatgcactatctttaataaagaaaggaatacaaggaataaaaataaaatataaagaataattattattccttccttttatatgttgtaatataaacttctttccaaactttaattctgtacagataacttgttcatatataacatctttttctactttggaaagggatgggacagaaagataagcagaaaacatgaagttctgaatttgaataaaagaaacacttttgctgttatatcaagaatgcaaggtgggtaacagggctagaaatagggaaattggaaaaatttcattggacttaatgattcataattcctcaaaaaattaaacttaccacattctgtgcaaatttttcaaaagatgttctgcgatccattgagtttccagacttacgtatgtggggtaggataggatgaagggaaataagggaagattaaaaaaaagaaagaaagcaaggaaaacagagcagaaaaagacaggataatgaaatgatgcaacaccaaatccatgttctaaatcagaaggcccatagaggttggagagccgccaagggaggcttcttctcacaggacatgggctctgcttacaccaaaaactttccttgtacaaacaaaatggtgtgattcaagcaaaatcaaattcagccaaaataaagtggatatgtgaagcctttatactgacatttgcagagcctaaatatttaaaaatctagcagcatatcctcagaatttcctcaaaacttttatgagaaaaaattcctattgacaacatcattaattccatagagcattaatgtctaatagaactttccaaaaggatggaaatctcattctatgctgtccaatacagaagcccctagctgtggttactgagcacttgaaatttggctagaatgttatataattttaattaactaatatttaaacagtcccacgtggctagtgactgctgtactggatagtgttactacaaagtatccatttctagttgtaaaggcaatggacttttaaaaatcttattagcctacatgacgatcatgaactacacaaaattataatttaaactcagagtttcaagaagctatgaactattttaacattaaaaagaatgaatgacgttgatgtttatgtccagattttctcttccctgttatattgattacataaggagttatgaacagagagacattgattattaacattgttgaataatgaggtctactacaatacccccataatgtgcttggctaccatgctaggtgtataaaattcatcacagggatattaagtgattcaggataaatgccaaataaaaatattcggaagcaaacattccgacattttgtcatctattattgaaaaaggtgagtctactttcagttatgaggcctgtggttcaaaacatacattctagcttactaaacaaagaaacctctcttcaagtttttgacctaatgactttgttactttcttttctttattgtaattttgattccatgaaactaggcatacagaagactaacatgaaacatgaaaacagcttctaataaattttgcaaagcatgaacatctgcagaaacaaacaaacagaaagtaatacaataagcaataaacaaacagaaacaacttaaatggcccttataaaatgcaaaggtttgggggagggtcttggagtatgttcacttaccattagtccaataccctggattcagcagaggtaattactccaaataattataactgagaactaggccaagaaaaaacaactcacaaaaaaccagtacctttttctttgcctgtagaagctcctgataggcactggatcttataaaacgtgggtatgaatcacttttcatcagtttgtaaatgtgctcctaaaaagaaataatggttgaggtgcttctttatgatttcttgggaaaagtaaaatatcatgatgtcacacatggctaaagaacaaatctagtagcagcgaaaaatagtaataacaatgctgattagaataccttctatttacaggatatttagatcttcaaattcattatctcattcatagatcattgtttaaattggtttaggagctactgaggaggcaaatcacatccagtcattacaaaaatggaatttgattaataaaatgtcataaaattacctcaaatcaagttgttgacttatatagatcactagagaatataactaaatttgctgtctcttaaaactactccaggcctgaagtgggtaatgttgactcagactgagtaatcatcctggatacctttggcctctacatttactgggagggtgccaactacccagaagaatcaaatcatctctttggtacaaattgcatggaaaattgtcttccatacccactttgggtcagagcacaagtccaaaaataaattttgtgatatttaattgctaaatctccaaatttgtgtgctctttcttattacttacccagtgacagattaggtaaatagttgatcatttgcccctaagaagtttgcaatattctgttttgatgatgaattttgatagacaagtcaaaaaaaaaaaaggaaaaaggtactcattcaattcaatctagacccaatctagggaggttccactctggtctaccgcagctcagggagctaacatgtgccttgatcttccaactctagtgaaatatcagttaggtgtagagcttggaactattggagagcattctgaatgttccagttttcttttctttctttttttttttcttgaagaaaatagatgtttcaagaaatgactccagttctctggtcttaaacacaacagcaataatttgaagttactttaaattcatttaaagacattcaggattaaatctcaagacttagcccaatggtgatcttcaaaggatgttaagtttggaactgtatgggaatttgtttgaaaagtagagcaatggctggttttggagttaagcattttgagattcacattctaccttgctcaagaactaccacttacaaatgggataaatataggccaactttttcatctctctgatccttaattttctcatctataaaatagcattgttgtgatgattaaaggaataataaatgtgtagcaaagcatggggtgtggatagtaagtgctcaaatatacttgggtatatggcaggtactcttttaagtgctttcctgtattagttaatataagccttacaaaacccctatggggttggtaaccattatgtccattttacaggtgaagaaactgaggcgtggagaagtggtcacagagcagagctgaaatcagaacccaggcaatttaccttacgatcagattttttttaaaaaccacaaaaaaaactagaattaaatatctgagcttaactgaaaaagaaatctagggccaagtggtattgttttctatagaatttttttttctgtaagaaaagaggatcctcttaggcaagaatatttttaaatgacaccgataactaaaaaaaattctattttaaacctcaggaagggcattccaaacattttccacattgttggctctagaaagatgctcggcattttatcttggactgaaagaaagaaaaatcagcagagaagtgagcagcagggccagagtttctggcctgctctctgtcctgtgtctctctagagtgtaattatttctacattggagaccatggctgaaccacatgggataggtatccagttagctgttaaaattcatgttagtttactacacagttgctgatttctttaaatgaaagccaaggagaaatatattttctatagagagtggaaataaggaaggatattcgtgtatctcattcttcatcttctatattttattttagtaatgtgtgttttttaaaaggtactttttagaattaatattcttctccaaaagaagtttaagaagttatgaagtatgcacgttctgatttaaaaaccaacttcaacacatcattagggagtgggtgcagtggcttatgcctgtaatcccagcactctgagaggctaaggtgggaggattgcttgagcccaggagttggagaccagcctgggcaacatagggagacccaccctgtctctacaaaaaaaaataaaaaaaaattagccaggcatggtggtgcatgcctatggtcccagctacttgggaggctgaggtaggaggattgcttaagcctgggaggccaaggctatagcgagccatgatcatgccactgtaggtaacagagagagaacttgtttccaaaaataaaataaaataaaataaaataccacattattaggaaacactatcccctcattacaagtttatttttcttcttaagtttcaacattttttgagagaaggcagaaattcaagttgtttctacaaagggaattaagatccagtttgagaaaagatgactgaaaatttgccttaggaagttagaatcagttttccttattttttctttctgtaggctaaaaaattaacttgaaaatttaagaaatgtcagaatctaatgtttgattttttttttcaccagagataaaactggtttgagtttgacataactttaagctaattcagtttgaataatttataataatgaataattcaggaatgtcagagtcttagaatgtctacattgaagatgccttaaagattttaaatctttttaaaaaaatgttttaaaaaatcttttactgaggtggggtcatcattagatggtgtttgctcacttactggggggacaaacagagtagaaaatgaagtaaaagttgtaaaatatttcaaatatgccccttcatataaaaatattcaaacttagaaaatattcccaggttttaaaaaaactattcagtttaatgtgtctttgttccttcctagatcagttagagttattttacagttatctaaattgaaaatgttagaaatagctgccatttagaatgaaaataaaatgaatacatctaacgctcaacttctcggaagcacgtttgtggtgtgaggctcaccgtacacccacctgagcatcttcaaatgtgtatcgtccaggttccttcacgttctgtgtggttttgtcataactcttggaatccaagttaatagcactgggggctccgggagccagaaactcttgccatatttcctgaactcttgagggtacttctttaataggcctctttttcaggtcctccactgccagccagaatctatgcagaatgtgagatcgggtgtttactctgatggcccatcatctgaaaattcttgtgacatttacggatcatgcagttcatcatgacgactcacagccagctcactttctctgagggcttccagtatcagggtggtactgactgtgttcaaaggataatcttctttggaagattattatgaaaaataattattaataaaaatataaaaatattaataaaaatattttaaaaatataaataaaaaatattaataaaaatataaagaaacatgaaaaactctctcttctaagtgtttgttgttaaaagcagatctgtcagagccccgtataacactgattttacctaaggaaagtagcacttctgactgttgattgaaaacaaagaggagtttgaagggaattaaaggtgtgggacatggagcctccaattgggagataaagctgtgcattacactgtgttctttggatgttctgtccatttcagcaatgggggctagtatggagagccttttctgttctaggtggtaagggaattacaaagaagctttgctggagttaaaagaggcctggacataagatcagaaaatgctctggctggaaaaataaaaacaattaactaatgttaaggtaatttaattgagagagttatggaatgaccaaagcagcaagctttcacatggaattatttgaaaagttgaaatgtgtagaggcatcattgcaattcagaagccacggaataatatatactgacttacttctgaagatagacttatttataccatatgtatactgaaagaacctgggagtgtgttttggttgataatagcaagtggtaaagtctagtgagaaggggccacattgtattaatcggttgcatttcttcaatattttgctctaggctagagcttgctggttagatctctagaaataatgtttaaaagataaatgagtatatcataatttgttaatagaaacaaacactctactagaaaaaggagctgctaggactgtgttatcctccataaacactcttactgctctaatagtagacgaagtcaaagaaaggcaaagagggccacagagacagcaaacttcaggctacagagtcttaagagaggcacaggtgatcagcagtaccttcgtaactactaagctttaacttgaccattaataaataatcagaaatcagtaatgaagtgcatgagctagaattagaatatcaactactactcagtctagtgatttttgagttttcatttccagattttgtttttttatagatatatgtagcagaggataatctaagtttgacaacgcctcaaacaggaaactaccaccatgacttttagaaaggaaggctcaagacctttccctcttaaaacacagatttagacactgtgcactctaataggaatactatgcgaggctgggcatggtggctcacgtctgtaatcccagcactttgggaggctgaggcgggcagataacctgaggtcgggagtttgagatcagcctggccaacatggtgaaaccccatctctactaataatacaaaaattagctgggtgtggtggcgaatgcccataatcccagctactcgggaggctgaggcacgagaatcgcttgaacccggaaagtggaggttgcagtgagcagagatcatgccattgcactctagcctgggcaacaagagcaaaacttcatctcaaaaaaaaaaaaaaaaaaagggaatactacgcataatccgagggagcagaagtgttgaaattaacatatgctcaggcaagttcatgccagcacactctgaacacatcaatcaaaacagtctctgtcctcaaagaatgagtagagaaaaagataaaccatttaattggccgtaacaccaggaagtacatgaatggctctctaggaagagaacgaactagacggtctgggaaaggcaagcaggaaagagcccctctgctggggcaagtgctggattggaaaagggggatctagacaaagctattctaaatccagtgacatctgaaatgggcctggaaataagcataaaatataaaggggttgagaagttaataaccacacctacactgttatgtaagtgcaggcactgctctaagtgattcacctatattaactcatttaattcccacagtaattctattaggcaagttctattatttccctcattttagagaagaggaaactaagcatatgaagattaagttgcttatttaaggttgctcactattactgtcacagctgaggtttgctcccagaagatctgcagcagatgacatgctcacaaccactccctcacacggtctttctaacagcatcattgcctttcttattctcaccattactgtaattattgtaatagcttaatagcatggaggagccaggtgcaatggcttgcacctgtggtcctagctactcaggaggctgaggtgggaggatcagttgagcccaggatttcaaggctgctatgagctatgacagtgtctctgaactgcagcctgggtgtcagagaaagatcccatctctcttaaaaaaaaaaaaaaatcctatatcctttatataggtggaagctaagtaagtatttttaatgtctttgattcttgatttcctcatcagtaaaatgggatgataacgcctatttcactgggtttccactggattaattggtttccattggattagttgattaaattaattccgttaatgtatactaatgatataaattatatagaaggcactgaaaagtacttggcatatttttagtcactcaaagataaaaactcatgatattactatgttttcttagcacttgctctatgctatgtgttttgctcaaaaaaaagaatgagggaaatacatcataaaatttcaagtttctgctctctattagggagagcagagggtatatttgaagcataagtagttatcgagaaacagtgcttcttatttttttcctgtcctaatatttgaaaaaaaatgctcagacgagtgacacactcactgatagcaggagggcagctgtttaggtaagatgcacggagagttattttattttaagtgcaattcacagccctgttgaccactggaccattttgtctccttcagtgtgtgacacagatatgtcagtggaagcagagtagggctcagatttggggagcagtggacagtagcttggtactggtttgtaggaaaccaagaatgccacttacatgcaatctgacctccttagccacactttctcggcttaaccttcctcagccacgcttttctcatctataaaatgaggcaatatttacattttatgttgttttggtggttggatgtgtgatgatcagaaataatgaatgcaaaatataacagcatacttataaaagtagtagatataaaatatattctggtgtcttgtaggtattcaagaattaatctacatctttcatttatctactgatctatacttactaaggaaacatatgataggcaatatagtagatactcaagaaatatatgtatatgtgtgtatgtatataatgtgtgtgtatatatataagataatctaatatttcttagatataatcacttagcctagagtctagtacggcatagaatgattaagatatgaaatgattaaagcttgaactaagaaattggcaggaattcaattcatgcctgaaacctagtatgcacatgctatcctctttttccaaaggcatcttctctcttcctgttttgatggtttatctcctccccattgtccagctcttagcctagaagcgatttcccctagtatcccttcgctgatctctaactctgggctaggcatccctctctgcttctcccaactaaacacccatgattttgtgctgtgatttgttttcttgtctgtatctaccaatagactgtaattttaatgagagaaggcgatgtttttatttggctaggtgaggctggtaaggcttattacttatttatttactcatgatgatacaaatgatatcagcatgttttcaaaaacttagagaatgagaggaatgtccatctccctagccactaaaatgcctcaaggatcctttatctctgctttatttttaatgcattctttttttttttttttttttgagacagagtcttgctctgttgcccaggctggagtgcagtggtgcaatctcagctcactgcaacctccacctcctgggtttaagcgattctcattcctcagcctccccagtagctggcactacaggcatgtgccaccatgcccggttaattttaattttaattttttgtagagatggagtttgccatgttggccaggctgctctcaaattcctggcctcaagagagccacctgcctcggctcccaaagtgctgggattataggcgtgagccctcgcacctagccttttaatgaattcttgcactcaattattgacaatgtgacctaatatagaaaatgttattagtagtctcaatacagaactttagcaactttagcagcaagatcttgcaaaagcccaagcatgaagggttcccataaactggaaggagaataggaagctgcatgccagcaatccatgccaggcacacacagagagttacattcctccgggttctgtctgtggtcattttgcttcatccatgcgacatgtgtcagcgtcctacatctttctgaatggtttgggattcctacctgttaaatctcctgaaaagaacgtgaccatgcctggcactacttcgttccaatgaaaataaatgaatgcagagaactttcagtaaatgaattttacaggactgcataagtcatggaaaagtaaaaattgggcatcagctttcaaaagaataatgaatgaaagaactcatgaaacaacagtcttatatagtggaaagttatcactcccttcaatgatgttaaatagagctattaaaatccactctaatgtcttatatttaaaaatgcaattttcagatcctccttatgttagcaagttttaaaaatatataaagatgatgtttacaacagatgggcagaatgggtgtcactctctcacgaacagctcaatgctgtgctgctctcaattgccctgtggctattatttaaacatgcaaagagaatgagacagcccaatagtttggtttcaagttatttgatatagctgcccagtctcttcttctctaacttgcttgagaagtgatacgcaaagatagtcaacaatgacaaataggtgatattttaattgaacttcataaatgttattggccaatctccactttgccaaacattgttctctgtactgcatttctttacagagtccatttcaaagccaccaaatttgtatagttaaaacatctggagatacagagacggcgtaaaaataagttataagaaattgatacgttggacagcctttgccttgctatctcttttcccttcattaggtggcagaaattcaatgggttcatgacatcattatgatgttagtggaagaataattgatctattacctccaaaataaccagacacatcacagacagtatttctctggcttataagatccaagcaatgtgttttaccttaaattttccgagctgaattctgactctagaaatttaaggaactgttctctcccaactgggtctttcaatgcctcgtccatgccaaaaccccatcgttttaccctctgctggctcggttctttgctatagaagataaaacaaaggcaaatacattcctttcattagaattcccatttttttgttattacattccccttcaaaatcatgtgtgcctcgaagttcccatctttaccttttctttaaaaatatatatatccgattaacggctctgcatgaaatcatcgtgtacattagtattaataataaagtctaacatttattgagcattatgtgccaggcactttacataaatggtctctttttgtttttgccaaccactttatgagatagccactattaatcttattattttccagatgaggacagtgaggcacagtattatcacttgccaatgtcaggcaagtaataaggggtaaagatccagatattctgaccccagtgccacatttcttttttcttttttttttttttgagatggagttttgctcttgtcacccaggttggagtgcaatggcgtgatctcggctcactgcaacctccacctcccgggttcaagagagtctcctgcttcagcctcccgggtagctggtattacaggcacctgccactatgcccggctactttttgtatttttagtagagatggggtttcaccactttggtcaggctggtctcgaactcctgacctcaggtgatccacccaccaaagcgtcccaaagtgttgggattacaggtgtgcgccaccatgccaggcacacatttcttaaccactacgccacacagggtcatgcaggtatattgaactggggaaaatgcattggtaaccaaaagatctcaatactagctaatgattctggtgtcaattaaatctgtgacctaatcccaactgagtcacaacattttggggttccagctttctcatctataaaatctttagcttgtggaggaagagttctgggcatgtccagtgtttaagattcatggctggatgcaaaagtgagagagaccagaaatgcaatctagagaactgctagaagtgtgacagagcacccatcttttctttgtaaagtgatacgccatgatcctcttatgagtctgttaagactgatgatgtagttctttccctagatagctcatgaaagaaactatggagtcctaagtggtgctttgcttttcttaggaagtgtcttgccagtttctcttacagtgtctatggtaagctcattctgtcttaaaattgaatttataaagacatacttgtgttgggcttaagtatgtatggctttagcattcactttacttgactacatgagactttgtggctacgtgaattttccaggaagataatagcaatgagctaaatttcaagagctgaagatcctaactctgactaattgcacctctaattttgggacggtctttccagcaatgcaaatcttaatgcaaatgcaaatcttaatgcaaatgcaaatgtctaagtttcaaaagccatgatctcgaacaagaatgttagatataggccaatgtagataaagaacaaaattacattcacaattagccaacaataaaatccttcccatttcactcagaccctgaaataaagcaacatatgggcgagaaagataaaatgccacctaccttgcctcaagttcccagaaagtggtgtcatcggacagccatgggttagaagggtcaggtggcaaaagaaacgggtcgtattctaaatactgttccgtgtaacttagtagactaaggagaaaaaacatttccagtttctttagttttctgactggggttgcagccagtccaaagcagggaaaacaatataaaaatgtgggaccaaggaatccttgttcacttaaagcatgaaatccaatggcaatcttcacgcttcagtaactttcatgcaacaacttattgtgcttcttggcagacaactgtggctaaagattccatctctacccatgcctaagccatgtaaatcagtatcccttggttaacatgaagcactatggaagaggtcagtgtgtgaagggcaccgctaagagtcagttccaatctttggttaatcagtccacccacagcagaacagattttatacaactgagagaagggcttaaaagggaaattttgtcaaaagtatttacaggaattaagtaaaatgggagccactgacaagttttttaaatgtatataaaaattttaaaaagggagaagggaaagaagttggggaggtaggatttggcaatgcccaaaagtgaagaatatgaatggcattaagaacagatttaaatgaagcaaaggaaaatatctgaaatttgagtttcattcatattctgaagtcaggcaggaacagtgtcaattgtcattgttaaaataagtttatagagaggctccagtttgcccaaaggtcatcaataaatggaaagtttcatgtcttccagcaggagtgaaaaggctagactctgcagaattatcctctatatctgattcttagtggaacaaggactggatgtctagacatttaagacaattataatcattctgtcatttaaactacatcaaaagagttctttgaaagtttttctatgtgcaaaaaggaaaacaaaatcacattacttacaggattccaattatctgtcccaactcctgtccccacagttctctttcatttttaaacacatgtaattgtcatatgaaattttaaaatttatacagacactttgaaatactcacctgtcagcgacttttgacatttttaaccgatgtctatctaactgtatttgccaatattttatctgaaaagagggttagagaaggagttacataagtaatgacattttcacaattttccactctaaatcatgatcagctgggcaattctgaacaagagtatagtctacgtcagtacaatttcaaagttggttaaaaaaatagaagcagagggctcttaaagagttaacaaaatgaaatgttggaatttgaacacaattgatatcactttagaagagcaatgagtttgaccattctgcctactttaacaaaatgtgattttattttaaaattgtagagattttgctgggtgcagtggctcatgcctgtaatcctagcactttgggaggtcaaggtgggtggatcacttgagcccaggaattcgagaccagcctggccaacatagtgagaccctgtctgtaaaaaaatatatacaaaaagtagccaggtgtagtggtgcaggtactatagtcccagctactctgggggctgaggcaggaggatcacctgggactctgaagcagaggttgcagtgagctgagatcacaccactgcactccagcctgggtgacagaacaagattctgtctcaaaaaaataaaaaataaaattgtagagattttaaacgttcattcatggtgaatacctaaatccagaatcatacttccctccaaatttagaaaataaatgtatttattactataatttcaaaataaatcctatctcctaataccaagaaagtatcaatgatatgtgttttgagaataattttatcaacaattcatgacaaatgctcacatggaataatcacacacagaaaactttaattaaaaacgctctgaatgacttttccttcctgattattgtaaatatactagaaaagtatattttacactcttgataaactatattataataaaatatcagaggaaaagagtcaaaatgagaataaagccccataactgaaccaatcatgagattatttgatttcagacactggagtttgctttgaaatattacttggagtcaacaccattgatcaaatgctaaaaaaaagaggtagtgtatagcatgactccatggctgtacgccagtggtgataagaaaaaacttcaagaggtagagagaaatcagcactgcagaaagcgagagtaagcactcttgtgaagaaaatgtcctatcattggatgtgggaagtgtgacaatgttctcaacctcttgtcctcttactctttaaaagagagctttggagtacaaagtaactattgatgatggagtcacttacaaatcagcatatgtgatttttacaattggttagaggaacaaggatttgggtaaataaagagtgaggggttttgaaaaccattaccatatattgatacattttcaagtaattacaatacttaaaattacaacattttattatcttttaactgcaaatcttccacatgaaacagtcagtcatacaaataacctataaaaatacccactattaacatttaccctctggttttcatagctgttactctgtaaacctttaacaggtcatctcataggttgactcacctgttgttgtaactcatcttctgttggaggtttagtttctggtgtgggtgtgtgggtaggactgtgacttctaatatcattttgtaaaccatagacagactatattaaaataaaaaataaacattttaggacaaaataccgtttacagtcacagactttctaaaaagtaactctagcataaattcagtaaggtctctcaaagcttatttgattaagcttcttaacaaaattcaaaaggcactgctaagataaaaatcaaatgcatataaaatagaagcacagctcggaaaaaatgtgtagttagattattaactttgacagaataattggttatatgtagagagcaaggtgcatgtgataaaatttgagagcaagctgggaataccaagttggagaatgtcaacactaactaacatttcataagcattgatttaagaaaatagagaggtggatgaagaatagaataggaatgcaataactcaaaagaagatttaaaaataactcgatattttacataggaattaaatggggcactgaggagagtgacaagtcaagaattctattgctgatttgatttctgatggtgcaatagaagacaccagggtactcctactctccatatcaacagtgggttatttacttcacaacactagccttgccattgggtgccatttgcaaacatcagtgaccccagaggcgtcatgcatcttcggaattctcaatacccttgtattttttaattaacttgtcaaaaggtcagacctactacttaggaagactcttttttgagaaaggcccattgcttagtaagtataaataaagatctggtgactaaagggataaaaaactatctgtaactgactatgagacatctcacgtgtcaactcaaggaagaagccaaattatttcttcttggatatcaaagtattattcctttaaaataaagaatttaatgtgtgttattgagcactttttctttggatatgagcaagaaggatgagggcataataaaactgcatgagctccacaaaattagtaccagataaagtttacaaagacacttttgaaattagatgaggttagatccagatgcctaatgatgccaattttcaggcccgtcaccaagcttgccaatatctctaaattcaatgtgtttttattcctgaactgctttcacttggaccttaaatccacttaacactacgtcttgactctgtatctgtcttgactctgtatctgcaccttttggatgtggttttgcccttgtgtctcccgccctccgtcctttttatttttatttttttgagacagagtctcattctgtcattcaggctggagtgcagtggcgtaatcttggctcaccgcaacctccgtctcctgggttcaagtgactctcttgcctcagcctcccaagtagctgagattacaggcacgtgccaccacacccggctaatttttgtatttttagtagagatggggtttcaccatgttggccaggctggtcttgaactcctgacctcaggcgacccatccgccttggcctcccaaaatgctgggattacaggcgtgagccaccgcgcctggcctccgtcctttttttggtgctcttatcctttctttatagattttaacttggacttaatcattggaataatctattcccagactatcttgggtaggcctcttcagtgtcctttcttgccctaccaccagaaccttggaacccaattcccatcactgaggatatccatttcttttttttctttttttataatgccaaacaagaggcaggaaatggccatccatttcaacacaaggatttgctcatatgctttgaatttactctgaacaggacggagctgaatgtcttaaactagcccttttatttcatttattttttcactcattcattcattcattcaacatttattgaacacttactatatactagatatagtactaagcattagggaaatacaaataaacaaaatagatgtgcttctttctgcactgggactcacaatccagtggaagggaaagaagttacacaggtaattacacaaataaacatatgactaaaaaagggagcagtattatgaaacaaaaaagaataacaagcatagggcctggaatataaagtgatttaatttacactgaaggaatggaaatggcccaaactgatactagccatatttgaacatgattaaataaaacaaccttctgaattctgaaataacagtagaggttgatttcttaaaaattatgtgttatatacataatggaacactattcagcctttatagaacaagaaattctgtcatttgcaataacatggatgagcctagaggacattatgtttagtgaaatatgctaggcagagaggtctttaccatagaattacacttatatgtggaatataaaaaagctaaagtagagagtagagtgacagttaccagaggctgggatagggggtgaggaaaagaaagctcttggtcaacgggtacaaagttagttagttaggaggaataagctctggtgttctattggacagcaaggtgactattgttaataataatgtattccatatttcaaagtaactaaaagagaggattttaaatgttcttgccacaaaaaggataaatatttgaggtgacgaatatgttgattactctgatttgttcattccatggtatatatgtttattgaatattacccgataaatatgtgcaattattatttgtcaattaaaattaggcaacagaaagatcaccaattatataatagttctacctttcagtatctgctagtttttcaactgtatcaccttaatttttgagaagaaaaataaaaagactctgagacttgaagtttccattcttttttaacttggtttaattatttaaagtttttaaataataatctacaggtcatataaacagtgcttataaaaaatagctgatggttttaacagtaagtttttaggcgaagattaaaaaaataacataaaagactgctagaaaaacacagcaatttgtggtatcatgaaagtaaaatgatctataagttatcttttatctctacatttctataatgatttcaacatttatgcatttcctgtaaacttcatagaggtccgatacgaggccgggcgtggtggctcatgcctgtaatcccagtactttgggaggctgaggcaggcatatcatgagatcaggagatagaaaccactctggccaacatggtgaaaccccatctctactgaaaatacaaaattagccaggcatggcggcatgtgcctgtggtcccagctacttgggaggctgaggcaggagaatcacgtggacccaggaggcagaggctgcagtgagccaagatcgcaccattgcattccagtctggcaacagagtgagactccatctccacaaaaaaaacaaaacaaaaacacaaaggtcccataagagaccatgacccaaaccattgggaggtgttgcttaaaacatcttccaggagcctggctacttgctctgaagttactgcagagtttccatttcttgtcttacgtaaaagtcaacatcaggaagtctccctttcaccaatctgagtactgttcatttcctggggatagtgatagcgtttaactttgattgttggctacaatgaaaacagccgagaagaatataattttacatatggggattattttatggacaaaggaggcaaagagattaatcctattttggcagacaaattatgaaaattatttgcaatgtaaaaggctttgcatgttttagaaaaaaaatgtattcaaatcgtggtacagggtggggtggcatagaactagaaacaggtaaggttagagaggaagagaaataaaatctcttaatgtcttaatatttgcagctggggaaaatcaaattaactaattgagatccatttttagttttaatagcaagatcatttatttgcaatgctttggcttgattaacacgttcctttattcctatggtgctaagacaagcactttttcatatgcagtgccatctatttattcattaaataaaatagattcggcctcctacataaatctgttcatgtgtgatttcccttgacattttagaagagaactagaaaaattatcccgtttttttttttaggcagggggtgggggtttgctatggtctgaatgtttgtgtctctccaaaattcttatgttgaaatcctcaacccctaatgtgatggtattaaaaggtggggactttgggaggtgactaggtatgagggtgaagcccttgtgaatgggattagtgcccttataaagaggcctgagggagctcgtttgccgattccacgatgtgaggacacagcgagaaggcaccatctttgaagcacagagtgagctcgcgaaagatattaaatctgctggtgccttgatcttggacttctcagactccagaattgtgagcaatacatttctgttgtttataaattacccagtctaagatattttgtcacagcaactcaaacagaccaagaactaagtcagagacagtaaaatagaaaccacaaagtacaagaagcctttctgtgtttctatgtgaaatgtaatctctggggcttttctgactgactggtgtggtagtatttctctttctttcacggttgctcagctgagctagagaacagattgtgaccatatctgacacaatatggaggaagtcagtacacagaaagaagcagagagaaggcaaccagagagagaaatcatgagagagctgggtcgactcacacctctgggcaagcttgaccactgcctgccacaaggtttcagaccatgaatcagaaaagtcccctcttggccgggtgtggtggctcatgtctgtaatcccagcacttagggaggctgaagcaagtggatcacctgaggtcaggagttcgagaccagtctaggcaacatggtgaaaccccatctctactaaaaatacaaaatgagcagggtgtggtggcacatgcctgtagtcccagctacttgggaggctgagacaggagaatcacttgaacctgcgaggcagaggctgcagtgagccgagatcccgccactgcaccccagcctgggcaagacagagtgagactccatttcaaaaaaagaaaactcccctctttattcattttcatttgagcagtttctattgcctgcacctttactataccctttacttgacacacttttgtgttgttctaagacaagagtagtttattctgttcagtaacacattaaaatttaaatgtacacatgctgtatatggagttgaagacatgtccatattttatgcagaaacagctagaaccactggattattaatagcaggaaaaccagacagctaattatacatttgctgttgtttttctaggatgtgcacattagcttttcactgatgctgttaactgtaatatttagtgccatgatgtccaaatgaaggtgacagaggaaaaagagaacaggataggaaatagcttactgttattttgaaatatgggtgctaagttacaggagggagcccaaagtgtgggtccaatcacacatacatgcagatgctcttatcatttccctcaggttttgtgacctaggacccctctagctattgtcctacagaaggatacagcctgtggtggtgaattttgtgtcaacttggctggctcatagtactcagatatgtggacaaacattactgtggatgtttctttgatggtgtttattggatgggattaacatttaaatcaatggactttgagtaaagcagtttgcccttcacaatgcgggtgggcctcatccaatcagttgaagtccttaatagaacaaaggctgacctcccctgagcaagaagggattctgtctccagactgccttttttgttgttgtttgttgttttgaagaacaaggatatttactcttaaaaaagaagcgctgtcccacaaaaagatgtacagatttgaaaaacacttattttactgtattaaaaaacaacaacaacagaaaaacaggcaggggatgtctagatggcagaattgaagcagctctgtacgaaaatgaagatggtacgatgatgtgacttcaaagaaaatgactaaaacaaaatttcacaaacatcttcacgtttctaataataatgcacaaaatatcaaaaatacaaagtctgggtttcttccctgtaggtttatgataaactattaaacttctatttaatgcatttactttcataagccttctttgtttagaagtacaagctatacaagtacatacatgctggtattttaccatgaaaatttcacttttcatctcaaactagtgatttgtcttcttacccatacttatatacatttcacttccatcataagacatgtaatacatttctagtggtacattttaatcaatatatattttttaaatattgatttttaaaagaatctttttagtgctatgatacgatggccttaatttaacagctgaagcatgatatggtaactacactgtactgtttaattttcagctgtaggaaaacatttgagttttaaaatataaccaagatgaggctggatagtaataaacaccgaaatactagaaaacagtgaacgaataaataatacattttttttcatcaggggctattcatcattttgtttttagaaacctggaagaaattgtcttgagtttcaaatgttctggtaaatctagtcgtttcttagcctcctcaatgtcacctggaattgctgaaataagtgagtctaaagaatcaaagttcttttctggtctgaggtagccaacaatggccacattggggatttccccatagaagtcctctttgaaggtatgcaggataagcgtgtccatggacttcttcgtattcttgtggtagagggtccatcctatgctcaccaccacctaaaggccatctccacttccgacactggcccaaccataataaatgccaatggatacatcaactggaagattagctactacttgttctggaaaattagctgcggagatgcccagcggcctggagccacggccgaagccccgcaccacttgggcccggcagaggcagggcagatgcctcacgttatagtccagtccgctcaggacacgggctgcggccgggtccgcgcgttctacggagccgccatcgacgcggtgcccggaccctggatcagcaaggggtggggtggggacatggccgtgagctctgcctgccgcgggggcgcaccaggggcctggcgacaagacgacacgccgcggtgggtccctgaggcaaccaacccaacaaaagcttcccggcgactcaagagctgtgtctccccagactgcctttggatttgaactgccactcttccctaggtctccagcctggtggcctcccccatgagattttgaactcgccaagcctcagtaatcctgggagtcaatgccttaatataaatctctgtctctgtctctctcccccctcccgccccccactctgtctctggttcggtttctctggagaactctggctaatacagaatctattacagtaaaaattttagtatcggactcaagaacatcagaccgacagttccccttcaaacttacttagattaggctgatttctttctggctatgctacattatcattctttcacagatccttgagataatacatttttacctatttccttatattgtagtaaagtatattctaattaaaaagaaagacttgaaaatagactaattttagattcttaacatatctcaaatcatgcatacagcaaagccttcgcttcctatatttgataaacatgtcaaacattcaacaattagatacaacattcccaaatgaaatgtgaaatgattctgatattcttcaggcacctatgctagattgttactttagggatttactgggtcctttattcttgtcacggcacgtaattacaggaaaaattattatagctcactcccaaagaaatgaacagcagctctccttgctacgagcattatctgctttcaaagtttaagcatgttccatagcttccacttcctgagcagccacagtataaagatggaggccgaccacacagccaggaggaggcgctacagagacggctcaattatggcggaagggaagggtggcttccaggggcaactggctggcctctgccatttctgtctgtggtttgtgatctcacagcgtcacctgctccgcagatacagagctgtggacccctcagagggtggtgaaacagcttgctgattgctgtcaaggtattcactgacaaaatgcagtggcaatcacaagcacgaatcacgtacactccctttgtcatatgtcatggacggagttgtgtcccctcccctaaattcttatgttgcagccctatcccccaacatagctatatttggagatcaggcctgtgaagaggaaataaaggttaggtgggttatagggtgggaactaatacaatagaactggtgtccttttaagaagaggaagagaccccagagttggttgttttgttttgtttttctctctgtctctatgcacacacaggaaaagccactgaggacacgagaagaaggcagccatccccaagcaggaagagacactccacaggaactgaacttgccaccaccctgatctcgaacttctagtttccgtaactatgaggtaacaaattcctactgtttaaaccacctagtttgtggcattttgttaaggcggccccggcagactacatgaagcttaacaaaatcatatacttatatccatgtacagacatttatctccttgctcaacacctgcacccttatgagaccatgaattaggggagcaaggccctgactgtcccatttactgtggagtacctaaagcccaggacatgtctggcatagagtacagactccttaattttgctaattcagtggatcattacagttcctaaacaactatgagctaaagtatcagtggtgatacttctaaaaaatattagtatgtggcttggagtcggataaccttccatgtaaaataacattatcatctgcgaagattctagcaaattgaacacttctgactgtgagaagctacatttatcaaaaggtgagaaaaatccgttttctccaactgtggaaaataagggtatacctgttatttgctgtcagatttttcaggacttttgttttcttctggcaaatgttagcgctagacagctctggagtgaggccctgtcattctgttgttactgattcacaagaaattagatgttatcgagacaaagagagctagatctcaatgactctgtttctttacaatatttcaccttgcaatgcctcatgggcttttcatcattaaatgagggctgatggtatgtaaagaacgacattgtaaactaatgcttctcaagtgttcaaaaagaagggtgccatgtgaaacacgagaaagatgatctatactgaatatggtgccgaagagagagtataaatgatgactttattgtgtctaggtgctatcttgttaatccatatgcattctcttctgaatcacagcatgtctgtgttagggtctgttgggggaaacaggacacccaataaagtatttcgaagagtaatttcactattcagaaagtggagagaggtggcttaatgcactttttggagagccgatagcatttttgaatcttgttctgcaaaaatagttcttggtgccctcaggatgtgctgtgagcagaggatgaaagcaattaagttgggccagccaccagagagacagaccagacaggcttgctttggtctggcttcgcctctctcttggagagttcctacgggcagaagcatttgagcaccgcatccgaattggttttgtggtgctttgcttcagcttctttatcctaacatcaaggtaaactgccttaaaagaaagaaaaggtacttggaccatattggggcctttgaacatgatggtatgtttctagggatgggagaaaatggcaacacaaaataagactagaaaaaaatattgagtgcttactacagggacacagactctggaaaacacgatggctaacgaaatactaaggaaatggccacagaaaaaagaccttgaactttgtggaatgtattaatccagcagcaccaatctataagctgtgttctcaaagcgactgctacaggccagaaattcttgtgtacatcaagcgtgttttatagaatgaataaaaatgccttctagttgtacgtgttgctttaaaaaatatgtagaaactattgctgtgcattttcaaagggttatttaaaatgtcactggactcagaatagcttcccccacaccctgcacaccgatattctctcagataacaaacactgaaatacaaccactgtcttatggttgtatcacaaaattctagtgttaagaggggcccctgcactctttctggaattaaatatcttttagatgtccccctttcctcaggttttaaaatgcccttctctcatcagtatcaggttttctaaagatgatttccttagaaatcctgttcctctcgtctcagtcagtcatgaccaccgctctgtcttgggaccctggtgtgcttgagcattagggtggggctattcttgaggaagggagggctgtggaaggctgggaagagtgggaaagatactgcatgacatgagaagaaagtgtttttatggctgacgtcctgtaaacaatgcaatccatcaccaagatcagcacaacaaatgacagttttaccttccgtgttttgtgggggtttctcattctggatgacttcttaatgtccacttcagttgtatttacacatccaggctgggaatggaaaaacagagagacaaatgaatctttgggtgtgaaatttctgaccaggacaatcatgaatggctcgctctccagagcccgagcaaatgccccaatgacacaaatcaagggaggtgttttctagatggccacagccagtcccatcagcagtagccagtcataaaagacatgatacttcttaactcttcacacttaaaagccttcagatgctatcctcaaataactcccagagaaacaggaaaaagaaatactcggactgcacatgtgaaagtggtgtcaatacgtatagcgacaaacccgacagacagagtgagggcactcctggacaaagagataccccttgctggttttctgcagacagcctctcgcagagatctctctttataaaaagtgaggctgggccgggcgcagtgactcatgcctgtaatcccagcactttgggaagctgaggtgggtggatcacctgaggtaaggagttcgagaccagcctgaccaatatggtgaaaccctgtctctactaaaaatacaaaaaattagctgggcgtggtggcgggtgcctgtaatcccagatacttaggaggctgaggcaggagaatcacttgaacccgggaggtggaggttgcagtgagtcaagatcacaccattgcactccagcctgggcaacaagagcaaaactccattgcaaaaaaaaaaaaaaaaaaaaaaaacaggctgttattagatgggtgccttgcttttcccaggctggaagactaaaatggcatttagttgagccagctcacatcccagaatgaactgtcttacaaggattgtgaaacccagcaactaggaatccttgtttgccatagacagaatgtgcaatggagttcatggttaaaatgtgaaagatggagaaagaaactggtaaataagatgccatgcttcttctgataaattcctgaccttccttttccttaagggcaggtgaacccctttaaaacagaggggttgatgaagtataggcagcctgctgttagcttcctgacaacctcaggtgtctcatttgtcagatttattgttctgttgtacagaaacaaatagatgcaagctccttgtatatttggaggaggagaggggaggagggaggaagaagaggggaagggagagaacatgaatcacgaaacagagaagacaggagattcaaaaatacatagtagcttaaatgtagaaagggcttagacatcacacatcctttagaagtgatgagaagttaatggctacatggactgtgtttcctttacttttggtgcaggatttaacgatctctggtattagtaaaaaacatcggccaggtgcggtggctcacgcctgtaaccccagcactttgggaagccaaggtggatggatcatgaggtcaggagttcaagaccagcctggccaacatggtgaaaccccatctctactgaaaatacaaaaattagcaggacatggtggcaggcgcctgtagtcccagcttctctggaggctgaggcaggataatggcttgagcccaggaggtggaggttgcagtgagccaagattgcgccaatgcacgctagcctgggcaacaagagagaaactccatctcaaaacagacaaacaaacaaacaaaccatcaagttgcatgtctctgctcaatttctctatttcttcccacagactgcaagaaattaaagcattagatgtccttagaagtgactccagagaaactgtgaatacggaaaagtcttccgtggagttggggtggggttgggaagaaagggcaaaaaggcagagctgatgtgattggcagactcagctgttcactacagtaacgggaatcagttcattgtgtaatgaggacagaggacactttccttaaagaaccatctcctgctagtatagccattgggccaaaactccgccataatattataatagataaggaagtaaatgaggaaaacatttttttttgtagaatatgtatatactacagatacacacacacacactgtactacaaacattaaataaattatgagtttggtttgcatatctatttaggaatagaaatcactggttcagcacagtggtcagcttggcagtgtaggagggaggaagggcacccagctgggtgggactaatttcctaagtgacactgagcaattcactaaactctcccagcatctggttgctgagtatgtgatattgtggtttgatttttttttatggttggtctaagcatttgttttttaaaaagacccccggggattttaatctgcagccggagttcacaaccactgatgtaggtgtaacaaagacaaggtttttaaaacattaaaggatcgagttttcactttccattcgatttctatttctttgcagccttccatccctaagcctgagccataacggaagggaaggcagtaaaattctttaaactcctatcaacatatcaggagccaagcacagtgccaggtgcagtggcttatgcctgtaatctcagcatttggagaggctgaggtgggaggatcacttgctttgaggagtttgaggctgcagtgagctgtgactgagccaccacactccagcctgggtgatagggtgagattctgtctctctctgtctttctttttcttttttttaaagagccaagtatgataagatgtgtcatagagattttcttccatatgttaaggggtgggaaaaattaggatataatatccaggaaaaggaaagcatgtttcttcatgacctggaggcaaagaaagataaaggtaagatactgagctcagcaggtgtttcatttttctcctctgtggaagaaactcgaagaagaagaggtgatagggaggaataaaaagtcccagacaagtatgaggaagcctgtgaagtagtcagtcccattcccatagaagaagccccacatgcaatccgagccaacatgaattttatatcatatgggtgttagcaagaaagatgagcttaagaaaatgcttcccaagcctcttatgtggcagtcaagccatccggagtttcttgcatgccacagtagtaaaaggcacagaagatctaagaatagtgggtggatgggagcctgaagttgggacaaaggctgcagtgtgcagggattttatgctggaagcagatgtctgaaacacaaacttcagcagtgagttccaggtgatgagatggtacctgttgcaacatgcaaacctgtctatagcagaaatcgacaaggatctggaagatgttctgggggtgcttggccctctggccccactgcacaagactgtaaaaacaaaacctctagaccccaaactctcttccaaaccaatcctggatagcagcagagaaaggccgagaaaactgaaaatgtaatcatttatccacaaatgaccgagtcatctaaaccaactatttcaattatggtggcatgcagagcacatgcgttgaaacctacccttcaaataggtttctgagaaaactatgtcaattatagaaaataaagaaactgtattttctttatacatctgaggaagctgaactaatttgaactctaaactccttccataaagagctaggattccaaatcaattttacttcataccaggggtcataattaacaaatggccctggaaatcgtgtcaaccattgaaggcataaagtggaaagattcccctccccagaggaacatatctgactgtcagtcctgaaggaaattagaagtttcatcctcatatttaaaagatgatggccttttaaatttgattaatgaaccattagcttacatctgaaattcccacttgagccaattattaacaccactaatcagcaaattaataagaaagcattgattttaaaagtaaatgtcattagagactgaacggtaagatatgttttataacccggctcccatcccaggaaaatgaaatctgccagttcaaagtttgttactaatgactaaatggttaaaatagtaagctggatctgggatgcttgtctcggaggccctgtaatttctaatgaggcctcatgggacagctaatggttcaacagatctatgatatctaagtcaactaggaaattcttgaagattaaaaaagcttagaggcccaaagttgcctggaatacttctgaataattaaggtcatgacccagtgctgataacccctgaataactgctttcagaagtcatgcactgtggtaagtgaaatatggcaataatttttcttgaattctcttatgtattcaataaatatttctttctgcatctaattgtcggatcttgtgacaaatggtgagttacagaaatgaaggcacgagccctatcccagtaacttcctgatacaataaaaacgacagacacatgaataatcagaatatgggagcataatgactaagtggaagttggcacagagcattacatgacaacagaacattccagacatcctttttttttttttttttttcctgagacggagtttcactcttgttgcccaggctggagtgcaatggcgcaatctcggctcactgcaaccgctgcctcctgggttcaagtgattctcctgtctcagccttctgagtagctgggattacaggcgggtgccaccacacccagctaattttttgtatttttagtagagacaaggttttgccatgttggccaggctggtctcgaactcctgacctcaggtgatccacccgccttggcctcccgaagtgctggaattacaggcatgagtcactgtgcatggccaagacagacatccatttttatgcacagtctgttggttctcctcaacatggcaaacactattcctttaaaagttatttttaagcaatttttcaatctcgatgagaccatgttgtctttggttatttaaaaaaaagtcaatcatctttttgatgcatatataataggtaccactagctggcaccagaccttcgtgaaattcgtaaaattggtttctgcagagctaaacaaatctatcttcccaataagatataaataacattaccattaccaagtagacattccattaaaatcttcaaatatatactatttgctggatacagtattaagcacatagtattgttggatgtaaggaataatgaaatgctatttacatcagcctggaagagaattgtgttatttctagtgattcaaagatgaatttcttttcaaccgaactaagctgggttgcaacattattataacgttatttattataaagtaggatttaacattgtggaagccactcctgagggagtaaacggagcatatcattgagaaatactactgtcataacatttacgtgagtgtcctcatgaggtgcaaaagagaagctggagtttttggtttcattattgatattttaagtaaaagcatctaaatgccatttagttcctttcatgcgatagtacatttttgttagttatagcagaaggtacacttgtgttcaagacaactcggcaaagcctgtggtgaagagcgacagtgagagagaggaatacagaacagctgtgtttaagttccatcactgcagctgatgtgtacctgggagaacagtgtcctaaacgacaggtgagtggaggattagaaatgcaccatcaaatagagctgatagcaagacatcaagtacaccctagaaagttttaaaaaatcatgattctgggaaaattcaggtttcaaatatgcatagtccccccttatcctggggggatatgttttactactgcccacccccacaaaagagatgcctgaaaccacggatagtaccaaaccctatatatgctgtttttcttatatatacacatgcttatcataaagtttaacttataaattaggaacaataagaaattaacaacaataactaataataaaatagaaaacaacaataagtaataataaaataataaaatatgccagcctcactgcgcttgggctttggggtcattctgaagtaaagtaagggtgactcgaacacaagcactgcaataccaggacagtcgatctgataacctagaagactactaagtgcctaacaggtgggtaccacagacagcgtggatctgctggacaaaggggtgactcatgttccaggtggggcagaatgggatagacgagatttcatcatgctactcagaatggcacgaaattacaaacttatgcattgtttcttgaattttccatttaatatttttggactgcagttgactgtgggtaactgaaaccacagagtgcaaccatagataagggggagctactgtatttagatggtccctgacttactatggctcaacttaaaatttttcacccttactgtgagtttattagagtattaaatgcatttttgacttactatatttttggcttacagtggctttattgggacataaccccattgtaggtcaaggagcatctgtatatatattaattcaaatagaagtaaattaatgaaaaagagtcaccgctttgtaatacagtacaagttataaaaactgcatgcatgatccatagtaccccagtaagaatgatcccttattcttacatgaagtaattatagattttaaagtgttcacttacatgaagtaactatagattttaaagtgttcagtctcaggacttttttttttttggcccaggctggaatgcagtggtgcaatcacagctcactatagccttgacttcctgggctcaagcaatcctcttgtctcagcctcttgagtagctggtactacaggtgagtgccaccatgtctggctaatattttatttttaatttttagtagagacagggtcttgctccgttgcccaggctggtctccaactcctggcctcaagcagtcctcccatctcagcctcctaaagctctggtattacaggtgcgaagcactgtgcctagccaggattctttttttaaagatccaattcaagcttttcttcattttcttaggcagttgtcagttgattcagcctctgatcctttcagccctcctcctcccgacccatctacttactaagtcctacgcacaaactgaagaaagttgtttgaggaaattgctccaaatttcttccattcactcttctctatagtatttactcatttgattcctattaggcctcatttgctagctacagactcttgggtatgatatcttgcttcagtgtatgctgtgaatgaactccacacatccaagaggcagaaggaaacagaatcatacgaagtcagcctgaagctgtggaaagtgggcaggttgagtagaagtcacagaccatgataaggtggtaaggactttggtttaattctttatttttatttttaaggttttttttgtttgtttgttttgagatggagtctcgctccaccgcccagactggagtgcaggggcgtgacctcggctcactgcaagctccgcctcccgggttcacgccattctcctgcctcagcctcccgagtagctgggactacaggtgtccgccaccacgcccagctaatttttttgtatttttagtagagacggggtttcaccgtgttagccaggatggtctccatctcctgacctcgtgatccgcccgcctcggcctcccaaaatgctgagattacaggcttgagccaccgcgcccagcccgactttggcttaattctaaacataattggaagccactggagagttttaaacaggagagtgacttcatatgatttatttttcaaaactcattcagaccttacactccacacacacacacacacacacacacacacacacacacacaaactcaaaatgaatcataaacctaaatgtaaaatgctaaattataaaatttttagaaaataacaggagaacatctaggtgaccttgagttgggtgatgactttttagataccctatcgaaggcacaatccatgaaagaaataattggtaacttggatttcattaaaattaaaaacttctgttctgtgaaagatactgtcaagagaatgagaagacaggccacaaactggaaaaaaaataggcaaggttattatccaaaataagtaaagaactcttaaaacccaacaataagaagataccacaacccaattaacatatggacagatgatctgaacaggcacctcaccaaagaaaatatacagatggcaaatacatttatacaaagatgctccacatcgtatgtcattgggaaaacgcaaattgaaataacgagataccactacacacctattagaattgccaaaatccagaacgctgaaaacaccaattgctggcaagaatgtggagccacagagattctcattcattgccagtgggaatgcaaaatggttcagccactttgcaagacggtttggcagtttcttacaaaacactctaaccattcgatccagcaatcatcctcattggcatttacccaaattgagtcgaaaacttatgttcacaaaaaaacctgtacacggatgtttctagcagcttgttcttcataattgccgaaacttcaaagcaaccaagatgtcctttagtaggtgaatgtataaactgtggtacacccagacaatggaatattattcagcattaaaaagaaatgagccattaagccacaaaaagacaaggaggaaccttacgtgcgtattactaagtgaaagaagccaatctgaaaaagccacagattgtacgattccaatcatatgacattctggaaaaggcgaaacgatggagacaaatagttttgccttttccagatcagtggttgccaagggttgggaataaataggcccagcacggagaaattttagggtagtgaaactgtatgacactacaatagtgaatacatgtcattatacatttgtcaaaaccatagaatgtacaacatcaacagtgaactctaatgtaaactacagagtgcaggtgataatgatatatcagtgtcggttaatcgattacaacaaatgtaccgctctggtggggttgggggtggggggttgataatgggggcggctgtgggccggggagaggttgctggggaattcagtactttccacttaattttgctgtgaaccaaaactgctctaaaaaataaaattgattaaaaagcaaccaaacaaacaactcattcaagaatattgagcactttgagagtggattatcagggtgggaacagggcaaagcagaagcaaggggcccagtttgaaggttactgcaattattcaggcaagagattatggtgacgtgggtttgcctgccagcactagagatgatgtgaagtggttgcatctgggatgcattttgaagctataatcaacaaaacttgctgatgggttttgtctgtgggcatgctgaaggaaacagaatatcaaggatgactcccatgccatctgctgagatgggaaagcctgtgaaaagaagagaggaatccaaaatgatccctgggttgtatttacatacaatgtttgtatttgctgaagtctccaaagggaatgcaactctttatgcagtctctatgaagatcacgaatcagagcatttccaacacaaatgcctgtataatcatttgcccttggcctgtccttttgtgccattgcgtttttgcattatcactggtggtatgaacatatcattgaatctgcaacattaaaacatgatgatcaattcctgagaatttggtggagctgtctctcattactcagagtctctgctacactttcctaaattttctgtagtcctaccacattctattaatctgctctaattgaaatcagaccacttcagcctcacatctagcaactatctgtgcatccttcaatgacattccctttttatagactaggaattgccttgcaggtaccattctcaaagagcaaccaagaggactctaaccagtacatttgctatagcttctttgtggtcactgggattacccatgtttaatgttcagctttaaattacctaaaatgttcccagttagaactgctttgaaatttaaaaaatcactgggcagaagctaagttgtcataattatctttaaaataggggctcctgcaggaagaaacaaaaggcctgaggcaagtaagcgtggacactttcctgtgacacctggcctgctgtgcgcacatgagcgattgatgtccttccctttctatgattatttccctacaaaaagctggctgcagtgtgaggacatgcaaagagtttcaattggatgagaaaaaaagtctctcttagatttgagactgaacatgtgtgctccaacttgttctatatcctgggttggcatattgggtacttttatacccataattgaactggcattttgatttgcattatactgttcctctggtatttcactggtgggagggtgagtagcaacacagaattttaggattcctggtctgtgggcttaaatgggtcatcaaacaccttaaacatttttactttaacacttaacatgtttcttgaatgcagaaattaagacatgaaatctaggctatgtctctggtgacaacataaatttccccaatgtaaaggtaaggtgccaaaaagtaggaaaatgaactagctactgaactggagaaaacaatctttatttttttacacagtgctattgttagtactggtgacttacatggtatgctgtaaaggctaaagagaaccaaataaaatttcatatagcatcaataactcacagtaaattcaagggcttataataatttttacaacagatagcaatgggacaactaggaaataagtttgtgaaaatcatcacatattggaattaaccttgaattacaatagctgccttgaattcaatagctttgaatcacaaaggatatggggggctcctaaatcataagttcccaaatagaaaaggggtgcatctccctgtcttagtctcttcagacttctataacaaaataccataaaccaggtggcttataaacaatagacatttatttctcacggttctggaggctgggaagttcaagatcaaggcagtgaaagattttgtgttgggtgagggtcacttttcagttcatagaaggttccttcttgctgtttcctcacatggtggaaggcataatagttctctcttggcctcttctgtaagggcactaatcccattcaagaggaaagaaccttcatgacctaatcaccttccaaagatcttagctcctaataccaccaccttggaggttaggaattcaacacatgaatttggggaggacacaaatgttcagaccagagccctccctttacaggacacacatacagagaaaggccataacacatacctcggtttagcaaaatctctgtaaagaagattaatttcaaagatatactctgttgcattcaacttgatttccaaaaagagaaaaagatgtagtggtgttagaaaagagatttttacataaagttcttttctagatttcatatttattgctaagagccaaaattttattttcagtgctagggaaaaaaaatcttttaaaataattcccatgcatcctcgcattcttacttaatcatatccaaaacaacagagtctttcttgatgatttgaggtcgtgattatttgaggacaatgcttattttttattattttttttttttttgagacagagtcttgctctgtcgcccaggctggagtgcagtggcgccatctcggctcaccgcaagctccgcctcctaggttcacgccattctcctgcctcagcctcctaattagctttaggattacaggattaggattacaggctaattttttttgtatttttagtagagacggggtttcaccatgttggccaagatggtctccatctcctgacctcgtgatccgcctgccttggcctcccaaagtgctgggatgacaggcgtaagccactgtgcccggcctattttgctgtctttaagacagcaatgcctatgaggctagatgatcccaactcctaatgccttttgagcttttatgtgattttatgccatttttagttcctctgccttatcccagttagctgtcactttttgctgctctcagcatccttgactccagcgcatctcattattctctaattcgttgcttggttctgatgtggatcagaaaactatacaaatgctcctttgccacagggtctcacattttagcgaatgaaccgatcaaagcacacggttagagtgtgagagtttaaacagctacttcggttaagactttttgagtttatttcttggctgagttttggatagaattagacttgaagatatgagaggtaagaaaaagtctcaaaactgtaacaaataaaatgtggacaagttctcatgatatatttaggaaaacttatcagtacatacatatcatagaagccaattaaagggggtcagaagtagatgacatcaaacatttatctggagttctaagaaagaggatggcatactgagagctagaaatttgttctgtgctccgaggggtggggagaaaagttaactgaggtgaagggcagcattcttgggttgcatctccccagatcctgagtgaacaatgatgcactctcttgtctacacccagattcttttggaaaaagcctgccagattcattgctaattttggtttagtttcccaaaaaggataaagtgtccaagccagaactctcagtttctctcccctcctacctattcttttcttggttttctgcctttcagtgagtgcctccaaccatccatcaagagactcaagccatcaccaaggaggcatcactaagccctcttttccccttacttcccacacttgattcatcagcgcatcatgcaaactttacctccaaatacaccccgaacctactggcttccctccaccctcactgttaccaccctgctccaagctgccatgatctcccatctggactatcacaacagccttcttatttgttctaattcctctcttgctttgtcctccctttccccaagttattctccacacagtagccagagtcacctttttaaactacagcgacatcacatcggtctcctcgtcaaacctccaaagggctctcgtcatgctcaggataaaaggcaaacaccttgccatgctctacgaggtgttacacttttcttttcttttttttttttgagatggagtctcgctccattgcccagggtggagtgcaatagcatgaactcagctcactgcaacttccgcctcctgggttcaagcgattctcctgcctcagcctcccgagtagctgggactacaggcatgcgccaccatgccagctaatttttgtagttttagtagagagacagggtttcaccatgttggccaggctggtcttgaactcctgacctcatcatccacccaccttggctgcacaaagtgctgggatttcaggcgtgacccactgcgcccggcctcactggccttctttgtgtaccaggcccttttctctgtactagatgctacttctttctccaaatactatgtagtccctctcgatcacatcaccttgcttttatttttatcatatcacttacctccacctggagggtttttgcacattacacttgtttgttttctctgtctttcaccactgaggggtaaattcctcaaatacagggacttcctatgtcttgtttagtatctgtcactggagtctgaaatttcctggtacctagtaggtgctcaatgaatgtttattgaatgaatgaatgtgaaagactttttgaacatacccatctattaaaaatacaaaatgagttttattttctgtttgcttgtgtgtatgtgtgtgtgtgtgcatttgtgtgtgcttgagaatgttggtacctataacttaacctcttggccgactgatcatcacctctcattattatcatacatttatttaacaggaaacaaatactccaattcttcagttagccttaaaagaaacatttctagtgcagaaaaatttagctcaaatgttcttttcctgtgcaatgtgattagcccatcagttgataagtgtaaatagcagattgcttccagatttgatgggggttaagtagttaaaaagcaggaagacactgggaacttacaaagcctcagttttagagaagtcaagatgagaatagagcaggcctctctgtccctgcctttataactttgtttaaagcggttcccatcttgacctacaaatatccaaggacaaacaaaatctgtgcccctatgcatttctttacccgggtgtgcaatggcacagcggagttcagacaacacaactgagccatattatacaaccagcacatctccactgggctgtattatggagctgaagattaaaaccccatatgagaaaaacctggattcaagatataaactaagaaaagataaagctaataacgcctcttctattgtgcagtactttgacatttttcaactataaccatcatctaatatgagtttcataagcattctctaaactatatagattagtcactatgaacctaattttcactgaagcatatcaaagattcaaaccttggaagagaatataaatattatctggtctaacttagcatccaattcatgatttcttctggcaacttctacgacaagagtcattcaaccttagctcgaatgcttgttgcctcctttcccctaaaatacctccatctgcatcacacttgaaagaaaatttttgaataagtcatttatttaaaggaccatgccacttttaaaacatgttaataatcatacctaaaaaagacaaataacatgatgacaaactagttaagattcttggaaaagtagaaacttctttaagccttggtgtctcttctttcagagcgagtgcaataaaaattgttccaacctcctcagtgtatgaaatactgcacgtaaaaggggtcagcacagttcttgacacacagaatatgcaaagcacatattagtttcccttagtattagtattattagcagtataatttgacatcaataaaataatcccatagaagcaagggactggttcttctatgatttcagattatgtttgtcaggaatttttttttttttttttgagacagagtctcactctgtcacccaggctggagtgcagtggcaagatcttggctcactgcaacccccgcctcccggtttcaagcgattctcatgcctcagcctcccgagtagctgggattacaggcatgcatcaccatgcccagctaatttttatatttttagtagagaccaccatgttggtcaggttggtctcaaactcctgacctcaggtgatccacctgccttggcctcccaaagtgctgggattacaggtgtgagccactgcgcctggctgtttgtcagtatttgaggaagttgcttatgaaagtaaacaagttgaactatactgaatggaggaaaagcaaaaagctaataaattttagtaattttaggccaaatatcagatttaatttttaaaaaggtaagcattttggggggggaataaatatagggtaagtgtggaggcaagagtgtaaaactcagttcacttcaaagttcttctgatatatcaagccagaccaatacgttggagttgcatttcctttctttctttcttccttccttccttccttcctttttctttctttctttcttttttggagttccattttcttaatggcagttttctttttttcttttttctttttctcataaggggtaactgctaacatttgaaaatatgtggccaagcgtggtggctcatgcctgtgatctcagcactttgggaggcctaggcgggtggatcacctgaggtcaggagttctagaccagcctggccaatatggtgaaaccccatctctactaaaaaaatacaaaaattagctaggcatggtggcgggtgcctttaatcccagctacttgggaggctgaggcaggagaattgcttgaacccaggaggcagaggttgcagtgagctgagatcatgccgctgcactccagcctcgggcacaagagcgaaactctatctcaaaaaaataaaataaaaataaaaataaaaaaagaaagagaaagaaagaaaaagaaagaagaaagaaagaatgaacatatgtaaggacaaatatctttttttcttttttctttttttttgggacagggtcttgctctgttgcccaggctgcaatgcagtggtgtgatctcagctcactgtaacttcaatttcctaggctcaggtgattctcctgcctcagcctcctaagtagctgagactacaggtgtgtatcaccatggctggctgatttttgtattttttgtagggatgaggttttgctatgttgcccaggctggtcttcaactcctgacctcaagtgatcctcctgccttggcctcccaaggtgtcaggattacaggcatgagccactatgcccggcctgacacatatctttatgttgagttttctcttaatgaaatgtaatttgttttgaaaaaatccagttattgattgtgaggaggtatatgcaattattgtgagggaaatagcagagctgaggagaaatctagagttttttgtatttgagagaggatttgctatcttttaaattaatccagattgcttttaattttaatttaattgtctttctcaggaaagagaaaattcatttgaagaagatagctgatgtcctattaagggaagacagcctatcttttctttctttcttttttaaaaatacaatttgtgcatctggggaaaagcaaatgaacagggaaaaaaaacaagctcaaataatgactgctctctgtgaaatcagagtccatgctggtcccgtcagggttctggcagactgagcccatgttgttagctcagccagcccctcaaagcctgtgtgcacgtgcatgcctgagtgtgtttgtacacattttaaatcttagtttcgctttgatatgatttcaaacctacaaggattgcaagagtggtttaaagaactcccatagactctttacccaggttctcctattgttaacatttggccccattttctccccttccttgtctatatttaaactactggcaaacagaaattcagctatagtaggaatggcccaagaggctggcttctcaatagagtatcagggttagatgctccccttccctccccgacacctgcccagacacccacaactatgcaagataccatcagtacttgagatcaatactatcctctatccacttccctgagagttagctgttggctcttaagaccttcctgctatcatcaccccaacccctatccacatcctcatcatttcagaagaaacaggacagaaatctgggctcatgattttgaaaagtcgccaatccacaagggataaaagcaccaacttaataataggggaagcagtttttattctcattctacccatggctcacataaatagcatcagatattacataataataggacactgtatctacaaatctattcagggatagaaagagcagacagaagatgaaagatatagccaggaagcaaaaaagaacagtttcactcatagcggcttgtgatagccagattgtcaaaatatttttcaatccaaaggaacagatgggaataatagacagaaatgctgttccattttcagagcacaaaagaaatatttaaatttggatgaacacattttggattttctaaaacagctcaaggtatcagtaatgagatcatggactattgataggaaagacagcatcatgagtatgggctgatttgaacttaagaacaaaaagcttgcacagttcctattgatttcaacctaatttgtttctcatgaacaccacaaaactgacaatgccaaagattaaaataggtatgtaactgatatcttccaagggaaatattagggaaaatattagggttctcctacagcttaagctccagatgagcacatgaaattatgcatgtggattgcacatcagttacaaaattaaaaagcaacctccctgaaatctatagaatactatacctgctggctcaaacccagaggtagacatgaacatttctaagggatatttatacctgttgcatttacttgacacaatccatgctgtgactcctttccagcagcctagcatggctgataatatgtagccgcctctcagagatgttgggacaatggacatatactgccctttgcctcagagttcaagtagacatgcaaggtgcaatagaccatttaatacataaaaaactcaattaatcatttcactaataagaaataaaaactagttaacatgcacaaagccggtcctggtgcgatataatatcctgctgtgtcttatgaattgacaaagtttgcatcctatgcaatagagatcacatggggttttggagaaaatgctaggttttcagtcatcattagggatttgactcttaaccatatcaaaaccaacaaaacccaactcttcagagtcttgctttctcttatttgttaattaaggaaaatagttacccaccccacgaagtcattgtaaagaataagtggtatgataaatctaaaaggcttttgccaccagaaactgctacacaggcaatcaatgttattgtcatcgatagtaatccacatgcattattgttctcttacattttgtagaaagaaatccaggtggcatgcatttaacatgtgttttagagtaatgtatcctgaagagagaagtagctcgaacagtaaaagggacaatgctggaaattgacaagcttctcgataactgacaaagtcctgttgcctcatctctggccactgctgccttggttggttcaaatattggagccccgtggaaaagaaaaatctgtgtgcttttgaaactaagtcagtatgtatttaatgtcatccaaaaggatgtagataggatgagggaaatcaagaattattaatttattcatgaattcaaaatctatccattgagtgtctgctgtgttcctggtacttgactgaggcctaaatacagagtcagggacaagtgaagcctagtctctgtcttcttatggggaacagttactacctcatatttaccatgtcattcccagtataaaaatcattcataaaaagtactttcatgttcatctcaaaagtttttttccttaatattatgaaagagatgatttgctctgcttaaatattgtggaagttaacctaaaatataagtgagtggtgagagacattctttagtttaggagggagatttggcaaagaactcatgcgccacagctgtgaggagtatacaggattatccccttattcccctcttgatctagggctttgttctcttcctcctgcttacaggttactgtaaggtggttccagcagcatctgcataggtcaccctcttcactgggaagggtttcattcatgctagggcttaacctagttttattttttccaccaccctttccaaattctattttcccagattctactgtggtgagtaccctccataacagtccctattgacctccttctgctggtattctcactctgtgtggtcccctcccacactgcaccagggttggtttgtgtaaccaataaactatgacagaagagatgacataccacttatgagattaggatatacaaacatgaggttttgacatggggctatctttctattttgggatgacatggcggaaactgtcttggacatccttatggagaggtgcatgtggccaggaactgaagctgcctgcaaaccaccatgtgaatgaagtgaaccatcagccccttcagatgaccatagccttggccaacagcttgactgatgcctcatgaaagaacctgagcctgcatcaccaggaaaaccactcctggattcctgactctcagtagctgtgtaaaatagtgaatatttgttgttttattccgctaaattttgggataatttgttatacggcaatagataactaatatacttaaccttcaaacttcaactccaactcttctgatccccaaaagtatttttcctgattataccagttcatagctatctgctaacctttttacccacctcctcatctccttttaaaagcatgattgctaaaataacttcagctaccaattactgaacaagggttgtgtgccaggtactgtcctaagcaatgtacaaatattatttccatgtgttctcaagggtcgtgtagggtaagtatttatttttcccatttcaaatgagaagtttgagacttggaggcatttagtaaaatctcactcaagaaggaagttggtgtttgagccaaatctttttagctgcagttgcatcccttgaacactacatcacataaaactgtcatagctgtgtgagttatcttgaagtctttgtatctgaggcagggaaaatataaatggagagagcctaagcacagtggcaggagtgggaagagaagtgagaatttttatgtaatccatcattcgggcatttagctcttgacacaatgttgccctccccaacttctgtctcactggatatctttagattaaagaaataacataaattttgcatgagacttttcgaaatcatggaagagtatgccaaaaatccataacattaccattctttatagtcaggtttttattatagaaatcaataagaagcctagtacacgccaatttcacctttgaatatgcatgtcaaaattctaaatcaacatacaaacaaaatccaatatcacattaagaaaataacacgacatgaccaagtagggtttatttattctgggatttcaaggatcactcaacattagaacatctattcatagaattcacatattactaacagatataaggacaaaaatgtataaaaagctttagaaaatagttttatcaatcatttctacttgtaaaaacaaatacactaaaataggggttcttattcaggggttctgcaagatcaaaattatttccataaagatcggaagccatcactgccttgttctcagaaatatacagtagattttcccagatattgtgatgacatgtatatagcaaaggaattgaatggagaaagagataggtgaatggagctgccttctagtaagcttatgattaaagtgatttgcaaaagtataaaacagttccactcttcctgctaattttcctttggaaaatgtgccaatttttcattaaaattacactgattattttattaagtgattggtgtcctattgttatcttacatgaaaaaataaatatttaaacagtccttggttttactgttgagtctgataaatgctaatagataaaacttgtataagcaaagacacttcaggacacacaataatttttaggagtgaaaaggaataataagaccaaaaaataataagaccattttcaaattttcagaatttgaaaatgatagctgtgtaagatacaaatgtaaggtccagtttcttaattctatacatagttcctttataaaagatacagcagaaaaggaaatctcatttataacgagaggtttttttttttaagaaagaaacctaacaagaaatgcatgagacatgcacaagaaaaatctaagatgctcctgaataacacagaagttggtaagaacaaatgcttaggatgactcagcttcagaaaaaaactcaattctcccaagttttctataaatgtataacatttgaatgccaaaaagggttcttttctggtgctagacaattgattccaaagatcacatagcaaaataactaggaaaaacctaaaatgaagagcaacaagtaaaaggtgtattgggattgagagggtctagacttatgagacataaaacactaaaatccaaacagtgatgggcagaatgtgatatctccaacccagatgatgccttttaaccattttgttgcctgtgtaaggaactcatcatccatttcctagtacaggcctcgctagcatatttcaatgataattccctaagtcttccctcctttctttcatcctaattttttccagaataattctatcatgtggtgtgagatttccagagaggtgtatctcttaaacagatctattctactttgcctttaattacatgtttcattcaacaagttacccccttcgtttttcttggtttattgtaagttctaccttactcatcctaatggctttcctctgtgatctgttatgttaacctcagggcctggctttgagcagcatcctgagttagtggaaggaatcctgagctgcaattcagaacacctggattcattcctggctcctctcaaagaaaaagaagtcctgggggaaataaaacaaaactcagtctctctacacttcagtttccttatttatgaaatgaggacaaaattaatgccaactgatatggtttagatatttgtctcctccaaatctcatgttgaaagggaatccccagtgttggaggtggggtctggtgggaggtgtttggatcatgggggtggatccctcatgaatggcttagcaccctccccttggtgatgagtaagttcccgagagatctggttgtttaaaagtgtgtggtgcctcccctcctctctcttgctcctgctctcactgtgtgatgtgcctgctcaccccttcgccttccactctgattgtaagctacctgaggcctcaccagacgcagatactggagccatgctgccacagcctgtagaacgatgagccaattaaacctcttttctttataaagtatccagtttcatgtattcctttatagcaatgcaagaatggtcgaacacaccaacctaacagagtaatgtgaaattaagaagaaagtttatatatgatcacattccgcacccgtactggatttaccaagaggcaggaaggtgttgtgataaagagtatgggtcctgggaccagaacacctgccttcagtaacagcttcctcatttagtacttgtggaactttgcacaacttaaatgtcccatgtctgagattccttatctgtaaagagaaaagataacagtaaaggcatatctcattttattgtgctctgatttattgttcttcacaaatattgtgggtttttgtttttgttttgttctttttgcagattgaaggtttgtgacaaccctgtgtccagcaagtttactggtgccatttttccaatagcatgtgcttgcttgctttgtatccttgagtcagattttggcaattctagtaatatttcagaccttttcattattatcgtatctgccatggtgacctgtgatcagtgatgcttgatgttattgtcgtgatcgttttgggatgccacaggccatttcccatttaagatggcaaacctaattgataaatattgtgtgtgatctgactgctgcatcttccactcttcaggcttccctattttctgagctacaacaatatcaacatcaggccaataataaccctacaatgacttctaagtgttcaagtgaaaggaagagtcccaagtctctcaatttaagcaaaaaactagaaaatattaagcttagtgagggaaagcatgttggaagctgagataggatgagagctaagacttttgagccaaacagccaagttgtgaatgcaaagaaaaagttcttcaaaagcacttgaaaagtgctactctagtgaacacacaaatgataagaaagcaaaacagccttactgttgataggaagaggtttgagtggtctacatagaagaccaaagcagccaaaacattcccttaaaccaaaccctaatctacagcaaggccctaagtcatcaattctatgaagactgaaagaaataaggaagctgaagaaaaaaagttggaaactagcagaggttggttcatgaagtttaagaaaaggagccatctccataacataaaagtgcaagatggaagcagcaagtgttgatggagaagctgcagcaagttatccagatctagctaagatagttgattttcgatgtagacaaaagagctttctacaggaagaagatgccatctaagactttcatagctagacaggagaagtcagtgccaggcttcaaagcttggaaggacaggctgactctcttgttatcaggtaatgatgctggtgattgtaagttgaggctaatgttcattgatcattccgaaaattctagggcccataagaattatgctaaatctactgtgcctgtgttctacaaatgaaacaacaaatcctggatgacagcagatctgtttacatcgtcatttactgaatatttaaagcccagtgttgagacctactgctcagagaaaaggattcctttcaaaatatacccactcactgacaatgcacctggtcacccaagagctctgatggagatgtacaaggagataatgttgttttcatacctgctaacacaacatttaatctgtagtcaatggatgaaagagtaattttgactttcaagtcttattacttaagaaatgcatttgtaaggctacagctattgtagatgatcagattcctctgatggaatggggcaaagtaaattgacaactttctgcaaaggggtcatcattctagataccattaggaacatttatgattcatgggaggagtcaaaatcttaacattaacaggagtttggaagaagttgatcccagcccttagggatgattaagggattcaagagtttggaagaagtaatcgcagatgtggtggaaatagcgagagaactagaattagaagtggagcctacagatttgactgaattgttgaacctcatgataaaactcgaacaaagggggagttgcttcttatggagcaaataaagttgtttcttaagatgaaatctacttccggtgaagatggtgtgaacattgttgaaataacaacaaagaatttagaatattatataaacttagttgataaaacgaggacagggtttgaaaggatgtattccaattttcaaagaagttctactgcgggtaaaatgctatcaagcagcatcacatgttacagagaaatcttttgcaaaaaaaagagtcaattgatgtggcaaactttattgttgttttattttaagaagttgctacagcttctccaacctttagcaaccaccgcccagatcagtcagcagctatcagcactgaggcaagatctcccacaaacaaaaaggttacaacttttgctaaaggctcagatgattgttatcatttttcagtaataaagtatgtttaaattaaggtatgtgcattgttttttagacataatgctattgcacacttaatagactacagtatagtgtaaacataacttttatatgcactaggaaaccaaaaaatgtgtgtgatttactttattgtgatatttgctttatttctgtcatctggaatttaaccccaaatatctccaaggtatgcctctactacctgtagttgttgtgattattatatggtaatttatataaagtaccaggaataaaacctggtacctggtgaatgttctctaggcactaataaactaactgttattatctactgcccatctttttccccaacttgatgaagacagaggtattgattctccaatgttgcctctgctctgtggaaaagaacttcagggacccaagaatatagaacctcaccctttcctctcacaatcaaaggtaagtaagagccaaacaagacaaaaaggaaattatcaacataaacattactttcccctggctctaaggcacacaagcagcaactcaagctaagggattcctgggggttttgtgttgctctaagtggcacttttctgaacagtgaaacttgatgaaggaaaagaccaattttaagtcatctggatcacaaccaacattgtctgtgattacccttgtcagtgtgtgttaagaactggtggtgaaatatcaagtattaatgaaggttgctaagtaaccacacaattacataaatcttttcaagtgcatttttgagtatttttaaataatgaggtaaaatgtaggacatcatatgaataactaaggtaatgcaaccacatgcatgtttaaagagatttctaggcctgattttcttagaaaaaaataagtatagtatttcccagggaaaatattgtctgtcttggagaatgtatcagttgcaatcacttctcttaaagtagtaaataaagaatagttttatcagaaacgactacaggggaatacagacatttttagaggaattgcttcttcaagataaccaagcatgttagcaacatgaaataattatagcaaaaattatattatttacattatgataacactctctcaacgacagcgtaagatacaacttcttggtccagattaatacgaaagctacattcccaacatttgagataatgaagccaatgatgggaatcatttgaaaatttaacaacactcctcacagtaacaatagtcagaagaacagacaatatcacttgcaaaaattggttcaatctgtgaactgataaaaggcagcagtcattcattacatgtactaccagatttcaaagcatgttctggccgggcgcagtgactcacgcctgaaaccccagcactttgggaggccgaggcgggctgatcacgagggcaggaggagaccatacgggctaacacggtgaaaccccgtctctactaaaaatacaaaaaattagccgggcgtggtgcgggcacctgtagtcccagctactcaggaggctgaggcaggagaatggcgtgaacccgggaggcggagcttgcagtgagccgagatcaggccactgcactccagcctgggcgacagagcaagactccgtctcaaaaaaaaaaaaaaaaaaaaaaaaaaaagcatgttcttcattttagaaatggcaaatatatgaaaatccatgctgattacgaaacatacaaaaaacattcaggaatgttctcttgggaacacttctggaaccccctttctggagctatttaagagaaatgtcacatatacatttttgaggctgaacaaagataataattgatagagacaatttagatgattgctttcactgtgtgacaatcacaccctggtcttaaataccacatcactggctaaaagagaatcaggcattaattgcacgtgcaagatcacggactttgatcatgggaaaagacggtctaccaaggagcaagcttcactcttgataatacaactggaatttaaatctcaaactttttttctcccctcttggtcatctattcccagtttgcttaatgtcatacaaatctgtaatgtatccaatttaaaaatttgaattcagaaaaaagcgttatgcaccatctctttttattaaattggctggaatatgatgctctcaaatttcaatccgagttcctttactcaataacactccaatttcaccctctcctaatgcaaagcactgaatagtaggggagaagatccaagtaatgactcaggaaaggagacgctacgcctcgtctggacttttcagacggcagagatctccctgccatgtgatgccatccactggacaattagaaggatgaaaacagttttcattcagacaaaatctgcctccttttatccaaagcaaagcaggctaatcttactcctttttccaatgacagctgcttaaatacttgaagacagatgagtaacagcatctaacttctctgccttaagcttaatttttcatgtcctctcacttactttagtacttcacatcccctccccggcctacacgggttgttctgttcactctgctcaaaagatgggcagagtttctacatgttgtcccctaagtatgcagtgcttgggatgggataccatacactctgtgtgttctgactatttccaggcatggcagaagcatgcctaccttcatctcggacgttacaggccaaacaggaggatttaaggatactttatccacaatttttcagagtataaatgtgacatctctttatagaaaattaaaattgcctatgatatcaaatatcccagaatagttacaatcaatattcagtatattgtctcttaactgtttctctaggtatctatttttataaacaaaattgggatcatattacatataacctttttttggatggtagaatcattgcaaacaatataatatttatttattcactcgtttatttaacaagcgcgtccatagattacacatgctgttgcattccagcctgggcgacagagtgagaccatgtctcaaaaaaaaaaaaaaaaaaaggagaaacaaagaagaaaaggaagaaattatctaaatttcttatccaatttcttatatttagataatttcttatatttagataatgtcttccttttcttctttgtttcttcctttttttttgagacatggtctcactgtgtcgcccaggctggaatgcaacggcatggtcacggctcactgtggccttgacctcccgggctcgagtgattttatttcacatttcagcatagtttttctccacatctttccaagtctttaaaattctcattttgagttatacaatatactgtcttgtggatatatcttatttaaccaccccggtaagttgaatagctatgcgatttcaaatgttagctaccctatgtttaaccactctaattttattgtatagctctggacaagttaatctacttgtgaaaaagattttatctttttaattcatattgtcaaattaatttttatacagataataccaatgcacacacccaccatagcatttagaaacacttgtctttctattgctcttgccaggattgcatacaattaatttgaaattttaaaataaaatatattgaaaaaaattgtcatctctttgtcttaatttatgactagaaaggttaaactcttttcccaatttttaatagccatttatatattttcttttatacatggtcagtttaagccctttatctagtttatgtgaaatcatgatatttctgaattgtttaattattttatacattcagaatatcaaaatttatttatcttgctccaagtattttcagattatctctatgcctttcaattatatttttaaacacaaaatcaagtttttaataaaatgtattagcccgcttattttgtgatttattctgctgtctttatgcgtgaaaagttctctagatcctaacattagctcaacgtaaacctctgtttcaaaacagctatattcatagctctactatagatctcattatagtatttgcataataattattcatttacacccccgttctacttattctggactctgagtatctcagtcactggggcagtatttttcatcctcttctctttagcctttagtgtgggaaactataaatgttggttgaaagacatactaaatgaatgaatcaactgtgtaatgcacagatttttttcagtgaaaatcaaagaaatgtaccactttacttctcttattcctttttttcttgccaaactattgtatgaatagtatagttagaaaaatgtattccacaggaataacgatattttatcatatacttgtttgtttaaagtacacaattaatatacaatcatgcctcagaacaacatgtggggtgtccatacaaccgtggtgcaactaatccttcaaaagataattttgaatttttagcattctctgaagaaatattttgcatgtatcaattctcatccaggagaaatcaatggcaggatttctcacaataatcataaggagaaaaatatttctcttatgattagtgtgatttttcagagaaaaaatatctgagtcatttttgtgggactctgcttctttttaaatcacattgatcatgtcaagaatgaatctaccaaataagacaaacaaagccaagcacactgagtaaagtagagaaccaatacatgggctttgtattttacttcaaggtcttgtctatatggcatacaaagacacacagtggaacaaccatcagcttttctatataggtggacctgatgttaggcaagtaaaattcactttatctgctgatatcaccacatgacgctgttttgttcttgtggtcggatattttgttgagttcattatactctcctatgatgtgccctctgtttcactttgtaaaaaagttatatctctatttttttttgttatgtcatggactttatttttgagtagtttaggtttacagaaaattgagtacagagaacagagaattcccgtatgtcccctcatcccaccccaaagtcccctgtattattaacatcttatattgatgtggtacattgtttcagttgttgagccaatattgatacattaatagtaattaaagtccagagcttgcattggggttcactcttggtgctacatacactgtataggctgtgataaatgtataacaatatgtatccaccattaaggtatcttacaaaatattttcactgtcctaaaaatctgtgctcttcctcttcatcatccctgctttcccttcaacccttcatctttttcctgtctctgtggttttgccttttccacaatgtcatagagttggaatcatatgataactggccttctaagactggtttctttcatttgtacgatgcatttaaagtccttccatgtctttttgtggcttgatagctcatcccattctatcattgaaaaacattctgatatggtttggctgtgtccctgcccaaatctcatctgaattgtagttcccgtaatccccatgtgttgtgggagggacctggtgggaggtaattgaatcatgggggtggttacccccacgttgttctcatgatagtgagtgagttctcaggagatctgacggttttataaggggcttctcccgctttgttctgcccttctccgtgctaccaccatgtgaacaaggacatgtttgcttccccttctgccatgattgtaagtttcctgagacctccccaaccatgctgaactgagtcaattaaacctgtttcttttataaattacccagtcttgggtatgtctttattagcagcatgagaatgaactaatacaccttccattgtatgaatataccatagttattttttgaaggacatcttgattgtttccatggtttggcaattatgaataaagttgccataaacatttgtaggtttttgtgtgaacagaactttcctattcatttgggtaaatacgaaggagtgggaatgctatattgtatagtaacaattcatttagttttataggaaactcccaaattgtctttcaaagtagctgtaccattttgcatttccaccagcagagaatgagagttcctgatgttccacatcctcaccagcattggatgttgctagtgttttggattttagtcatgctaataggtgtgcagtggtatgcaattgttgttttaatttagccctaatgacgtgatgttgagcatctttttgccctctgtgtatgttttttggtgcagtgtctgttcagatcctttgtccatttttaattggctgttttattactattgttgagttttaagagttatttgtatattttgaataccagtccaaaatatcagttgttttgctaatattgtcccagtctgtggcttgaattctcataacatcttttatagagtaaaagattttaattttaatgaagtctaattcattagtctttataatatggatatatgatttttttctttttagcctgtagaagtaatcaattatatcaattgattttcaaatgttgaaccagtcttgaatacctggaataattcccacttcactgtggtgtaaaattcttcttgtacaacgctggacatgatatcctaatattttgttgaggatttttgcatctttgttcatgagagacattggtgtgtagttttccttccttgcaatgactttgtttgctttgggtattggggtaatgctagcctcatagaatgagttaggaggtagccactctgctattttctggaaaagattgtaaagaattgatataatttgtccctctttgctagaattcatcagtgaacccatctgggctggtgcttcctgtcttagaaggttattaattattgattcaatttcttcatttaatttactgttttttaaatttttgagacagggtcttgctgtgttgcccagactggtcttgaacaactgggctcaactgatcctcctgtctcggcctcccaaagtgctgggattacaggcatgagccatcactcctggcctaatttctttaattgaataggttaatctttaataatagatgttaagatgtaggccttctcattaatatatataggcccatatatattatctattttcttggtaagttttagtacattgtgtttttctttctttctttcctgttttttttttttttttttcttttggtccatttcatctaggccttcaaatttctgggcatagagttgtttagaatatttcattattatgcttttagtgtcacagaatcagtagatatagacccttttatatttctgatattagtaatttgtgtcttctccctttattccttagttaacctggctagaggattattgactttactggttttttccaaaaaaagttttgattttattgattttctctatattctcttgccattctcattgatacctgctttaatttttatcatttcttctcttctacttactttggatttaacttgttctcctattcctagtttccaaatgtggaagtttagattactaattttagatctttctttcttctagtacatgtactcaatgctataaatttctctctaagcactgctttcactggatcctaaaaattttgataaagcatatttttattttaagctagtttgaaatatttttatatttctcttgagactgcttctatgacccatgtgttatttagaagtgtgttgtttaatctactagtattttgagatattctagctgttctgatttctagttttatatcattttggtctgagaacatactttgtgtgatttctattctaaatttgttaaggtgtgttttttgacacagagtgcaatctcttctagtgagtgctccatggaagcttgagaagaacgtgtattctgctgctgttgtattaagtattctatagatgtcagttagatccagttgattgacggtgaacttcagttaaaccttgttcttagttccttactgattttctgcctgcttgaactgtaaattactgatagaggggtattacagtctcaaaataaaatagcgtatttatccatttctccttgtacttctttcagtgtttgcctcatactttgatgttctgttgttaaatgcatagacatcaaatattattatgtctttatgaagaattgatctttttatcattatgtaatattcctctttatctctgataattttccttgctctgatgttggctttgtctgaaattaatctagctactccagctttcttttgatcactgttaacatttaacttcatattttaatggatttgtacacacacaggcacacacacgcttgcttcgccaggctattctatacaaatttatttgaagaaaaatagatacgtagggacatttatgggactacaggcaagatagaagaaagacaagagaccttccaaatgaataacaaatcctctttcactctctatgccttcctctaacaaactgaccttgtatcagggtttaactattacctttagcttaatgagtttcagaatcaattctatatcccaaaacatccctcaaattttggtctcatgtctacaactattgacaagatctcgctccatctgaatgtcatgtcatcacactcagcatgccctaaaacaaactcactgttccaaatctgctacgaacccttagcaaaatcctttgtaaatttcatatgtccaccattttctcaactactcagactcaatattttgcattaagttgtatgctacaaaatgttaggtttaggatagggaattgaagacagactttctgctcttcaagagatcatggtctgacagatgttaaaacaagtgatctggtcagggtcaacgaaaatgctacaaaatgctgattatatattggttttaaaaagcataaataaatcaactattctcactactttgtgattaggatttgcttaaattgaagtcaggaagaattcaatgattattgtttctatattgaacattctgatgaagtacatttccatttctctgcttaagcatttttatccgtgacgtctttgttgaatgcttggcatgcattcaaccctaaactaatagactggggaagcaaagaaggtgatctaattcttattgcttcagtgctggaaagaactctaaaattatgaatctcattttctatccagtgattgccttttctccattctgtttctggctcatgacttctaatctacttgaatttatcatttgcatcattagaagttggcaatgacctttagatagctttgagtattaggaagcttttatattgatattttattttccagtcattttcatagtagtcatacagaacccaatgtgtggtaaaccaataaactttattccaactctgtttaataacatttcaaaataggaagacactttccatgggaattctcattcctagggtcactaatcttattaataatttcacaatttttttttgttcttgcttttttttagtttgcctccttaccgtccatccattcacctcttaactccagctcatccacattctttttaaagtatggtgcagaggattgggcacaaaatgctaaaattgagtttcttcagcactttgacaagtagaagtttcactgcaatttagctagatgttaaaatcctgttaatacaagctactaacgcattattctttgtgtgtgtatatgtgtggggcttcattaaattattgaaacattaaatacacaagtcaacccaaatactatattatctttgtcatcctacaatttggtgtatttctcccactatattcttcagtagttagtttctggcaattctgtctggagtccttagtaagttaagagtcctttttagtgttatgaccttaatttttttttctggagtaaatgttgacatacttaggaggctaactttattttatagagatattaagtactagaatgattattctgtgtcaatccgacctaaaagtgacctcatggttttttgaaaggtaaaaaatcatattatgtatattttctacactctaggtaaaatgcacataatatatcatattttacattaaattgactttaagtatattttaaagattctgaactgttatttcaaatttccctttcctcactacatttctggctaatggcttccaatccattcttgaggttggaataataaatgctcgtgtcaaatcggatcaaataaaagtattcaaaaggcaaggtagcatatcacctttacttgaattaaaagctttagaaggatcaggtgttacctggtttttttttattgaaaggtgtaatagcagaactgtgaaagggaaaacaaaatgaaaaacattcaacaaaaatgctgttaggataactccatttctggcttttgaaaataaagatactttatatatttatgaaggcaaatcgattcaggaaaatataatgacataacttaaaagtctttcagttagatcgtgtcacagatctgtgatatttaagctttttattctaatgggaatatcaatctcaagacttttaaaattgatagtgattgcttcatagtttttcaattaaccttctgaaaaaccataacaaaaataagaccctactttcttatctctttttttttacgaataatttctgtaaactaaatatgtgtgtgtgtgtgtgtgtgtgtgtgtgtgtttgtgtgtgtattttagagacagggtttcactctgctacctaggctggagtgcagtggcatgatatagctcactgcaacctcgaactcctggccgcaaggaatcctcttagcctcagcctcctgagtagctaggattataggcatgcaccatcatacctggctaatgttttgtagagatggaatctcactatgtcgcccaggcttaaatatagtttatatattttaaaaattttaggccgggcacggtggctcatgcctataatcccagcactttgggaggctgaggcgggaggatcacttgaggcctggagtttgagaccagcctggccaacatggtgaaaccccgtctctactaaaaatacaaaaaattagctgggcgtggtggcatgcgcctgtaattccagccattcaggaggctgaggcaggagaattgcttgaaccggggaggtggaggttgcagtgaggtaagatcgcaccactgcactccagcctgggcgacaacgtgagattctgttttaaaaaacataaataaataaaaataaaaatgtagatcctttttgaaataataacgtatgtaggttgttacacaatattatcatatctaaatattgaagataggacttatcaggcagccctgttggcaatagccctctagggtgtatattgtataaacatccctggcaggggtattctacacatgttagttggattcccctaggtcaggggtgtgtggtctataatatatgaaaaatgccctgaactctggacttttaaaaacagcaaaaggatatgtgaaaaccgttttaaaataccattttaaaatacaacaagacacctataaatacagctattttttcaaaagcaaaaggacatatgaaaaccatgagtaaaatataataagacacctataaatacagctatatcctctgcggactattgcattctatttattctttctttttgcaggatagatacataaagtcaggatctcattcttgctggagctacttacctgcctggacccacaccaccccctagttccaggcctggctctcccaccgctagctctgaacctgagtacgtcctataaacaacatgagcatctgtatctcccttcagaaaacaaatggtgcagtcatactcatcctgctgtgttaatgactatgttcataaaatgcgacactggactacgagttttaggaatcaaggagtgtgttttagtccactctttatgactggccttagtataatatctggcacatactgatatagaataaaaggtatcattacatgatacctttctatattatatccacatgtatcccatgatccatgttccatattatggaagggtggcaacgccctgtttcacgagtttcagattcaacttttgaaggaaacatgttttagtcattgcattggcagatggctccaggacttacatatttaaataacaaaaatgttggggataaaagtattccccaaacagttcaaaaagtttcataggtgggtaaaggaaccatccctttgaagaggaaagtcaacagtctgacttatttcaggtaaacaggttgataaagacaaagaaaggctgctttgttctaagtcttgcgttcctgcacctagaggacagatcccacattccagaataaaggcttaaataaaaatgcaagcatacaggaaataaaagagttcaaaaataaagggtactaagagagaggggtcatagattagcattaacaccatggtgaccacatcagccttaagtcaaggtcagactatttcatgcaagttatccctaaatggaagagtggaatgataaggctggaggaaaaaagagatggctatgggagtggtcttcagagttattctggttgggacctcagaactgaagacaaaggttgtgatgctccttgattgtcctctgtgagattcatagatgtcattaaaaccatgaagtacaggagctgcatttgcattatctgtttccatattccattttttttttgctttttcctttttttttgctactctctgtttcttttcacgaagaaagctgaaaatttattgtctttcacctgtcaagtgagatgctaaagtgatctgctagctgcttttacccatataatctcatttaatgttcaactaacactgcaaggtaggtagatatatttccattttataagtaagactgctgaatcttagaaagggcaaatcactgtgcaaggtgggcctcgtaaataatggactcatgtctatctgattccaaagcccacctgcttcccactctgccccaggtctccctattcccttttttactggttgttggctgacataataaaaactggaagtgtacacaataggacagtctcttagatatggacatcttctggtgaggggcggtatgcaatatcaggccccaggccataccagattaagcctctggacagtttgagatactctctggtattttcctacacgtggtctgggattctacgttgctcaggaggcaataatttggtgttaacatggaagacctagcttcctagcttcacagatcctgtctagaagacacttaaattttacagtgaatactacaaggtacaaagagtctttcattacagccacagtcaggacagactatgaagaagaaactgagctatagaaatacctattcactttaactctgggatataggatttagggtctaaatatattaggattgattatgacaactgcagaattcatttctagggacaaatgtaaaagtgtagacattcttagaaattatcacaatattgctgttttcccctatgccactttttcttgagggggcctagttaccttagaaagttcttgtcattgcttagctaacactacagccagcaaatagagatagagcttatgtgtttggctgagaaaataacataggagctctcttaggagaacctttctgttaatgtccctgtcatcatcatctttgtctattaactcacagtaaggacccaaaagactaaaaacaagataaacaccagtacctgtatggcagacacagcctttggacaagtgtcagcatttcgcaagtgcctgagatcacttcaaaatgtttaaatttttaaaatgccaagagggattacctctaaagtaatacaggaagttataatgttaagaaaaagaaatggttgaaggtaggattggttttaggcgaacgccattctcagaggctcatgacaacccgaagctctattttcctctagaaaataagggatgatggccgggcgcggttgctcacgcctgtaatcccagcactttgggaggctgaggcgcgtggatcacgaggtcaggagatcgagatcatccttgctaacacggtgaaaccccgtctctactaaaaatacaaaaaattagccaggcatggcggtgggcacctgtagtcccagctactcaggaggctgaggcaggagaatggcctgaacccgggaggcggagcttgcagtgagctgagattgagccactgcactccagcctgggcaacagagcgagactccgtctcaaaaaaaaaaaaaaaaagttcaacaagggagatggagccagtggcttctgggtggtttctgcctccagatcctccttgggatgactttctagttggaagcctagtgaaggatgtggtggaggcctcttggataacactcatatgtgctccttgctggtgggagacacgaaagactagcgcccgacttgcactggatagagggaaagacaactttgatcagattctgcctccaacagaggcacacaaagggctaaggcaatggagcaggggagtgtttgaggtgggatcatgtgtcatctctgtgagcatgagagtctcagagcatgaaatagacgtgggcagtgcaggggagctggcatggtgtgagtccttttgggttgccaggaggatccaggtcatggaagctaaacgaggctagagatgagccaccagatgtccaggggacaaagtggataagcacaggaacataacacattgactggtttctagaggttgcttaaaacaaacaaaaaaaataaaaatcctacttaatgtccttgcaatagctatgcacctgacctcataatcctttttcttcatgaacaataaaactcacactgaattttcagtagcaaagccagttaattctcagttgattctctttgaatctttccagaattcaaaagagagaacaaattcaatatagcatttaacaattacattgctatctgaagctgaaatatgtacatatataaacaaacctttggagactttctattttggtctgactctgaaggtagttgggagaaaattgtaaggtattcttatcaatcttgatttgtctttcatgctatgaacctattatttattctaataatacttatataaatattattctctactgccttgtctgtatttaaataaatctacagaagaaaatgatacagcatcaaaatagaaggaaatatacgaggttgtcttatagttgctggtaaccactgtttaatttcatccataaagttttctggtattaattaaggatattcattaatattactctgaggcacgtagtttaacattaataaggaagaaagccagctaagttattagagatccaatgttatgtcattaaaagtgtgagctgatttgaatttgagccacaggaaatgaaagtctgtgaaagtcaacaaccaaagcaggctactaataggttttaagaaagaaaatcaggctgggcacggtggctcatgcctgcaatcccagaactttgggaggctgaggcagacagactgcttgagctccggagttcaagaccagcctgggcaccatggcaaaactccatctctatcaaaaatacaaaaaattagccaggcttggtggcacatgcctgttgtcccagatacttgggaggctgaggtgggaggacggcttgaactgggaggcagaggttacagtgagccaagatcatgccactgtactccagcctgggccacagagccagatcccataaaaaaagagagagagagaaagaaagaaaagaaaagaagagaaaagaaagaaagaaagaaagaaaagaagagaaaagaaagaaagaaaaagaaagaaaagaaaaagaaagaaaagaaaaggaaagaaagaaagaaagaaagaaagaaagaaagaaagaaaggacggagggagggaaggacgaaggaaggaaggaaggaacgaaggaacgaagggagggaaggaaaatcagggcaggaataacacttgtactatgaagccagaaaaatgtaaacaataaaacatgaaaaactgttttgttgcagtagtttttctttcaaatgtatacagaagcatcagataccttcaaatagcaagagagtaagcaagcgatatcatggtgggaaaatgcatggttttataaattaaatacgatgctattgaggtctagtcatcctacacaaaagtggtgatcttttcttaatgaattcaccaagataccatggagcgtgcatggggtcactacagtctttcacttactttggcagggcacccctcacttcccacagacggagaagatggattcaagacgagagtgcgacgcttgcttaccacgggcctgtgcacgtcccagaacgctctctcttggctgtcaaggatcttcctttcaatcttgtctctcttcttgtccactctgtcaacacagtaacaatagataacatttagtattaattgtagtgcctctctgaacaaaaaggccacaactggaacaaatcttccaaacgactcacaaggactcactttgcttgtgcttctgcttgcatgaaaatgaactcccacttccgggcaaatgctctctgcagcctggccaggctctcctgaaaaacataccccaggtgaagacatttggtgttcattgtcactgctctcttctagcttagttaccacttgtatttgtcaaggaaacaaatagagagtttctaaagccctaagtgtactgtggttctcaatgataagtcatgctccctgaattcagctcatcttcatattggcagtcttaaaggaagcagaaaaacctgttacaaatatcgattttttgaattactgactttggagaacaggactacaaacccaatatgtatctgaaaaatactaaaattacctagtacataaggaggtgctcagatgaacccactggatttttcggtacccactttatagaggaacagaacatcagtacattcctactacgcatgcaatcagcctattcagttcctgacaatacatggcacaccctggcggcccacaacctattcctacacagtgctttgaattcagaaaatctaacatagcaaccatctgcacaaatgacagcagatgacttttatctgctgaagatcactgtcagcagagacaattttggcaaaacccactctttcccagggtaaatggtctttaatcctcagagtttggatatcttcactatgtaggatgtatctgacatttcgacagttaagtcgattttagaaaataagatatgcttcccttttatactttgagtttatgtatttagagttttgccatatgcaatgtgaatgaagagaggaagtaagcaaacagggattcatgcacccactgtgatgccagatccctagaaatctgacccttcagatccatgaatgaggctgggcgtggtggctcgtgcctgtaatcccaacactttaggaggctgaggcgggtagatcacctgaggtcaggagttcaagaccagcctggccaacatgacgaaacccagtctctactaaaaatacaaaaattatctgggcgtggtggtgcacgcctataatcccagctactccagaggctgaagcaggagaatcacttgaacctgggaggcagaggttgcagtgagccaagatcgtgccactgcactctagcctgggtgacaagagtgaaactccatctcaaaaaaaagaaaaagatccatgaatgaagagttaacatcctgcccagaaaaggctgtgggccttactgctgtgcattctatgactatctttgccagaaggtccttggtacttacagcctcatagtctgcgagctccagtcgtgccttgttttgcattgttctcttgcagaggtaaacggctgaaaaaaaaatcaatcatttcttgcctgcttatcaacaccatggcactataagtaaaagtacaacattacaaatcaagggcattgcacttttttcccaagttgtaatttttgatcattttcttagacaaaaaataattatgtaataacattattactgaaattcaagcatcatagtatttatgataccctaataaaataaatatgctaagaaacttggtaacttttttttttcagagatggtcttactctgtcaccctggctgaagcaagtgtagtggtaagatccttgttcactgcagccacacactcctaggctcaattgatcctttcgcctcagcctcccgagtagctgggactataggcgtgagccaccaagcctagctaattttatcgttattattattatttgtagagcagcttctcgctttgttgcccaggctggtcttgaactcctgggctcaagtgatccttccacctcggcctctcaaagtgctgagattataggcatgagacataatcatttaaaaatttttattaaatggtcatcacagtttttagcatcttcaacaaataagaggagaaaacaaaacctcctaaaagggtcaccaaatgaacttaaaaatctatatatccaaataaaatcattttgtgaaaaggaaattatgaattagtggcacattcaacgatgtccagattctactgtcaactgaaacaatctgttcatgtacactgaagacttcttgcatcttcttggcttcatttcacaagagccaatcttccatcgttttgtcactaggagaagggtatcacatcttacctaccttccacagtatttccattttcctgaggagtcgatggcctgggctaccatggaaagtccatctgggcagcagatttataggagaaggtggtgacagcagtgttgcaattgagcaaatttcttcaattatttcagggtattccagtgactctcatgacaaactcaaggcattcacagccctctggtagagtcccaattgccagaacatttttgtcattgtttttcactaaatatgcatgatatttgagtctcatgaaactcaagatacattgtatctgttctagatgctgagtaaatgcattggatgaggactgtcaaatattacttattgtaagtctacctctgtgagtttgccttggaaatatcacctttgcactacacttaccaccccaagttttggataacgacgtccagctggtatcactaaggaaacacactacacagaaaatttaagaccggtgcaaacaggaatactatttactcaatttctgtaaggtttcctgtatgaaagtcaagacgaaggagagagccaaccacagaatgatgctgacattcctacaaatgctaagaacccagtatatagtattagaacacatctttgtacaatctaccataataattttattgttctactaatattagtaatttttaaaagtcagacttcataaacaaaagtgacatgatgtgttcatttcctaattcatcataactgatgctcactcccgaaggatctcttactatagacgccactgtgacttgaataaaatatctaaaatgttctaagcagttgtaaaagaaattgaagcgtaagtgaaatacccctgagggtgtctcttcatgagagaaagatcaaattttcttaaatatctaattgaataatttcagctttcctgtggaattacctctgatgaaatttcaagccccagctatgccctccatcagtcacacctcctgtgtcctcctgcatcagcttctccttgctttattggttttgcccatctaatctttattatttgcaaaatcagctccctttggggaaatgtttctcaccattaggtaccctaatgccttaaagcaagagtgggatgattttattttttacatgactgctcacaaagacattatgtatcttgtaatacaggtgtcctatgatgtgatttttctttaattctctagggaaaaaaatgaaggtgcgggcagacagtgccaggcataaaatattggtatcacaaatatttgttgaatgagtgaattaacaaatgaatgaataggatatcttcagaaggagctatttcgaggtcaaatcaacttaagtgataaaatctccctaaatgtctacttgattctttggtataaagaaagacaggaagcagggcatggtggcttatttctgtggtcttagctacacttgggaggctgaggaaggaggatcatttgagactagtagtttgaggctgcagtgagctatgattgcaccactgcactccagactgggcaacagagcaagactctgtctcttaaaaaaataaaataaaataagaaagaaagaggcaaaaggtacaagtctgagttagcagtgtacagaataatctggtaactgttgaagatacagcaaatatgctcttgaccggataggcccagacctcatcagtctagtccagacacagttgctgtatgatgacaggtacagataatactttttattctttattagcagagagtatcagcattggtcaagatgtggatgaggcagaaggtccaagtagatcaaagatgattccaattcaggaaatttcccaattcattgaagactgacaaaatgaatgcactcatgcatagtcaaaactacagctcaggctgggcacattggctcatgcctgtaatcccagcaggttgggaggccgagatgggtggatcacaaggtcaggagttcaagaccagtgtggccaagatgctgaaacctcgtctctactaaaaatacaaaaaaattagccaagcatggtggcaggcgcctgtagtcccagctactggggaagctgagtcaggagaatcacatgaacccaggagacagaggttgcagtgagccaagatcatgccactgcactccagcctgggtgacagagcaagactccgtctaaaaaaaaacaaaaacaaaaacaaacaaacaaaaaacttcagctaaggcaaggtgcttttgtgccaatcctaattattttggcactgaacatgctctatatggtgctaggtatagacctaggcccagacccaaaagagtgaatcttttataacataaccccgaatatttcctgctgtgatgaaatattgaaaatatcaactaatgatgccatttttggggttctatttaaaatattttctattattaaagatgtaatttcaataccaagtttaaatatatctccctgcagtagttttctgggagatcatcaggagacaatttggaagacttgggaggtcaaacaagtaatttaacaggaggctatgccactaagtgggagaaagtttgggcaggcctgaagtgctactctggctaagaaagctccatagataaggcatagattttggcccaaatgcaacttagaacttagatggaaaagtcaaagtttctggatcccatctttgagtagaaacagaatagaaagtgagtgctgacgtcaggtcttcccctttaatttataaagctctagagaagctggagtggtctctcagacaacactgatgcccatgacaaaggtatgaaagcacatcacacaggtcagcgagaaaatcactaagaccccagtatcaaaatgtggaaagagtaggaatatatcattcaccaagactagaactacaaaagtccaataaatattttaaaattacccagcttacaacccaggtaatgcaaattaacttacattgtcatgctattcttttttttttctcttttaatgtttagtttgtggctaattcttctcttgttcctgaattttaaacagtcaggcagtttgtacaatcttccttctcatgcttgagtaattcaaagagtcccaagttatttgagagatgattgggtcatgaggatggaaccttccttaatgagattagtgcttttattaatagactcgaaggaggtggttcacccttctaccatgtggggacacagcaagacagtgccgactatgaaccagaaagtgggccctccccagacatcaaatcagttggcactttaatcctggacttctcaacctccagcattgtgagaaataaacgtttgctgtttataaacaaaacaaaacaaaagggtaccaagttattaatgagaatgttcatctcaagtaatgatcaaataatcatgcaaattgtgggtgagaagaagtgtgagtggcttctttctcccctccccaactcccttttgtgactctcaccaagaaccatgaactgaggcctctgatcctcctggggctggagtgtaggagaggaaaggggaagactgacatttttattacatttttcattggaatagaactttattatatttgatggagattttgaattttattgctgagataaaaaattaaatctggtatgtaacaaaaataaatatgtgcttcacaggagctttcctttattattttaacattaaaaatttttaaaatattttagttgataaatgagaaattgcatatatttatattgtgctacgtgatgttttaatataggttatacgctttgctatgactaaatcaagctaattaacatttccgtcacttcacattcttaccactttttgtgatgagaactttgaaaatctactctcggccgggtgcagtggatcatgcctgtaatctcagcagtttgggaggctgaggtgggcagatcacttgagctcaggagctcgagaccaacctggccaatatggtgaaaccctatctctactaaaaataccaaaatttagctgcgtgttgtggcgggtgcctgtaatctcagctactcgggaggctgaggcaggagaattgcttgaacccgggaggcgggggttgcagtgagctgagatcccaccattgcactccagcctgggtgacaagagcgaaactccatctcaaaacaaaaaacaaaaaacaaaaaacaaaaaactactctcttggcaattttcaagtattaatggtaactatcatcatcccgctatacaacagtcttccagaacttagtcctctaactgaaactttgcgctctttaaccaatatctgcccccactgcccccaggccctggtaatcaccattctactttttgcttctatgagataaacttttttcagattccacacgagtgacatcacgcagtatttgtgtttcagtgcctgacttatttcacttaacataatgtcctccaggcgcatcatgttgctgcaaatacaagattttttgtatttttaaaggctgaatagtatttcattgtgtatctatcccacattttctttacccattcgcctgttgctggacacttaggttgattctgtatcttggctattgtgaataatgttgtaatgaacgtggaagttcaggtatcacttccaaatactgattttattttctttgggtagatccccagaattggaattgctggatcctatggtagttctaggttcattatttgaggaacttctgtacagttttccataatggccgtactaatttacattcccaccagcaacagtgtatcagggttctcttttctccacattctccccaacgcttgttacctttcatcttttcaatcaaagccattcttacaagtgtgaggcaatatctcactgtggttctgatttgcatttccctgatgattagtgacggggaccaccttttcacatacctgttggccatttgtaggtcttcttttgaaaaatgtctatttaggtttcttgctcattatttaattggcttattcgtcttcctgcttcattgataccaccagggtgatctagcttgccactctctagacttggcaaaagtttaaagctccttatgatttttacggtacctttagcctctctctatgatgctgtttgcccctccagtctgccatgtaggacaggactgtctcacacagggtttagatgatgcctaagagaaacattcacacattttattttttgccttaatagaaggctgcagaacagagccacctccctttcaactcttccacccatagctagacagcctgcctcttgcccttcagaatcccatggcctacaagtctgtggcctattgtgttcccaggggtgcgtgactctcatctagcactctcagcagccccttgaagtctcttatcaggagtgagataaggcgcggtcacccctggctccatccactcagggctggtggaagcaatggctcccaacatcctatggattccagactcggtcttcaagacaatgccttgcccttagacccttgatgtgagcagaaagcaattactgggatcatgcatatgttagtggaacacagcccctttacacctgatcttgacccacttaacactttggctgggtttccatgttaacatcctgttacagaaaccattttccactcagcaaaacagcagagagtttaaaggggaataatccattctggcaaaagaagagtgaaagagagctgctggtgggcaaataaacaggggaaagtctccttggaaaggacgtgagagtgagtaataaagccttaaaacattcatggccataggctgggtgtagtggctcacacctgtaatcctagcattttgggagctgaggcaggcagattgcttgagctcaggagtttaagaccagcctggataacatggtgaaacccaatctctactaaaatacaaaaaattagctgggcttggtggtgcacacctgtaatcccagctccttgggaggctgaagcaggagaattgcttaaacccaggaggcagaggttgcagtgagccgagatcaggccactgcactccagcctgggcaacagttgaatgagactttgtttccaaaaaacccccaaaaaattcatggccataattctaggacttgcttttctaggactattacccaagggaataacaggaaagctagagggctaagaatacactatattaaatatggaaacacaaaggaaattgcaagaaaatcatgaatatctgttcaacaagatactagatcatcattcaaaatgatgtgtacaaattgttctacctaaaaagctgaaataacttgatttgtaaaacccttaattcctcctcattgtaaaagtccagaaaaatatataaagtaaaaaatatacagtaaatatatatgtctaaagtatttatatatttatatatgtaaagtatttatataaatatataaagtaaaatatatacagaaaaaatatataaagtaaaaaatcattataataccatttctgtcattatttggtatatagtttgattttcttttatatatacatctgctaatacacatatgaatatctgtttatatacaaaatctatatgcatatatttattttaagtgtgctcaaaactgtaccacacatgctgtattataaactttcttctttaatagtctgttgtggctaacttttcatatcaataagtgctggtctataatattttttaaaaaattatttcatggtaatccagtgctgagatgtaatgtaatttattttaatgagttcttattattggacatttgggtgatagctattattttgctattatatgctaacagttgtgtgaacatacacgcatgtatatatatgtgtctttatgtatgcatctttatttgtttttgaaattgccagtttcctgaaagggttattgctgagtcagggcccatgcacctttcaagacctgtgatctttataaccaaatttcagaaagtttagacatgagcatatatcagatgcttttcaactctggagagtctattttcagcaaagccatcagagttattctgttaagacataagtcagatagtcagtgtactcaaaaccctcccttttatctactacttcccatctcatctctctctaggaaaagccacagtccttactgccccattaagtgaccctctggatttatctcccattcaccttccaccctgcctgagcctcacaccagatgtcccctatgtcttctctcctttccgtctctggagagccctaccccagagctgaactgaattctctccagaatatcttcccccttctccaccaagcccctttcccagtttttctccacacaacttttcatgtcctaatgtacaacttatgcattcatttatgtagttaacttcttagtttttctccccctattcttcttccctccaccgacccaccagaatgtcacctccaccaggacagaggtttgcctattctgttcaccaatcaatccgcatggctagaagagtacctggcacatagtagatgctcaaaacatagttggggagtgaaaacatttgcctagtgttcattcgaggttttgtgttttcttttctttcttttcttttttctttcttttttttttttttttgctttgatgaattaactaattaactataatttgctgatttttctattgggtatttaacatttttaaattagacttaaggcccattaatacattagagataaaaactaatgttaggtatatatgaggaaatatgttttttccccaggttttgggggaaaagtttactaaacaatgcagaaaatattcagcatacttaagagaatactgatttggtgtatacacacacacacacagaggatcaacagtacatggtctgcaatctgctttttttcacttaaaataacattactgagatttacccaggctgttttcaatagatgtagcttatttcccttaactgctgtagtctatcctatgaatgtagctcacattgattagtcatatccctattactaaatacacaagttttttttctttttattttttcctttttctattacaaagaacaatccagtgaaagtttctctaagcatatattcctagaaatggtatcaaagggttgtggcgataggcacagtttgaattttatgacactgccaaaattgtcccataatacttgtccagtaatgtacaaatattcctaccttcattccagacttgaatttttgccaatccggcttgagagaggtgcattaaagtctaaccctttcagtagatttctgtgtctgttttcttgtatctccaacagttttcatatcacagattttaatttcaaaaatgtctacgaatcgattgtccccttcactaatgtggctcaatttaatactttttaccttggattattttttacttgaccaatattgcaagttcaaattttattttctacatgtatttgcctggtatatctttgcctcaccatttattttaaacgagtcagtgtgtcttacttctctttcctctggaaagatatttgtagattttatttaggatctaatctaaagatacttgttctttttacagatgaatttaaaaatccccattcatttttgaaagctgtttgtattccttttctcaagtcttcatcactctccctctctctgatggtatttcttttgttttctaccttttgttagatggagtgagttttctttcattcctacgtttataactggaaagtgacaaaacttgttaccactccgttagtggccatgctcatatctttgtacaaatgcttaaatatgtatttcttgaattttaatctcagaaactgaacactgcttattattgcttccctccataaatgatggagaaattagcatatcttcactccctccagtctttccaacttttttaattactagaatttatcataaactctgtcatagttttaaaaaataattatagcattcacattccattcagaaaatatttttatcacaattatttagattctgcagggcatgcagagaaagctggtgtcttggaaaattaaggctgaaaattttgtcttggaacagtggtttttttaaaaagtctatatttgctgaaattattttatcaaatctcagatgctccaaaattgggcacttcctatcttattttattattctatttgagacagggcctccctctgtcacccagactggagtgcagtggtacaaccattgttcaccatagccttgacctcctgggcttaagtaatcctcctgcctcagcctcctgaatagctgagactcacaggcacatgccaccatgcctggctaattttaaattttttgtagagatggggtctccccatattgcccaggttgatcttgaagtcccgggctccagcagttctcccgctctggcctcccacagtgctgggattcaggcgtgggccatcgctcctggccctgtgttaagttactcttatttctggtctttggagtttgcttgctcatttataagtgaggctgctacactggtgaagttcaaatagagactaatgctattaatcttgggtttcccatcacggctgttgaccagccactgcagcaatccttcaaggccactgcattgctctcctcccagtgtctcccctctaccctcgagcttgctccccagtgtctgagagagcctgtgctgctctataaactgaggtcacggacaaagctttctcctctggtgccacgctcatgcctaagaaaccttgctccaagatggggaaagcctttctgccctcccaggacccacttatttccagccctcatgcatcaatatggggaattcctactggggttggtcagaattccatccaatgctaatttctcgagaaagtctgacaccaccatgtcccttccatttggctaaattttattgattccagaaaaatgttaatttttcaaatgagtagtgtgtggtaccattctaatttccactctgtgctaataattccttttcctctggttttgctttctttttattctttgcaggaagagggagggaaaaattttggtaaacttctggaaagtatggtgtattagccaattgttacttgtaacatcaaccccaagactcaaatatattttgtaattatatttatgctgaatacacatatatttagaaccacagtgatttttggatttaaaaaaacacatactgcaattattcttattttcatgctaaagaaaaagataattatgttctttaaaaacagcattttcatggaatatgatgcagccataaaaaaggatgagttcatgtcctttgtagggacatggatgaagctggaaatcatcattctgagcaaactatcgcaaggtcagaaaaccaaacacagcatgttctcactcataggtgggaattgaacaatgagaacacttggacacagggaggggaacatcacacacggggggcctgtcgtggggtggggggctaggggaaggatagtattaggagaaatacctaatgtaaatgacgagttaatgggtgcagcaaaccaacatggcacatgtatacatatgaaacaaacctgcacgttgtgcacatgtaccctagaacttaaagtataataataaaaaaaagcagggttttcaaaataattcttcaaataaaggtattttaaatttactgttagtagagtactttaaaatctagcattaatttaaagatttagacattagcaatgcacttataagaatgaaaagttaaagaataatttggagaattttatttttaaaatttatgactcaacagcaactgaaacatttattaagtgcaagggaaattgaatcttaataaaaacaactagcaataatattataaaatttgtttttaattatttaattttctgatacatagtaataaagactgtgttgtcataaagtaagagtaagagttaactactatatgggatcatataccttgataaaagaagatttactaggataagaaaggtgtactatgaacgttgaatactggactataaaaatctttttttttttttgagagagagtcttgctctgtcacccaggctggagtgtcatagtggcatctcagctcactgttatctccacctccctggttcaagctattctccagcctcagcctcccgagtagctggaattacaggcatgcatagccaggcccagctaacttttgtgtttttagtagagatagggtttcaccatgttggccaggccggtcttgaacccctgagcacaagtgatccacccgccttggcctcccaaactgctgggattacaagcatgagccaccgtgcccggcctgtgcaaatctttaaataccctcctgggaggtggtgtccttaaggagaaagaattcctttaggacagttctggaataatggccaggaactattaataggaaaagaattagacctgtgaatttctgtttctcccaaaggaaagggaaatgtcattgaacgattctaccatgagcctacttacaattctgctctatcataaggcggttacatgtattatccagagccttaaattaacaatccaaggaagaagctactgtcctgtttatttaattgatggtaatgatgaaacccagagagctcaagtcctctctcggggccacatagtatgtcggcaagtcgggggttcttgggtctcagtgatcacaaaacagatacgacacacaaaacgtgaaggcagtggcaatgaaggagacaattccactctggctctcagtgctgaaaagggagaaatatgcttctgttctttgaagtgtccatttttcttggggtccattttttttcatttctgagaatatggcttctcctttaagaactgttattgtcattctaaaggtttactgattgaattcagctccctctgcattcatccctaaactacattacagattgtatgttacccttactctcactgcggaaattgctgatgaaacaaaatagagccatttaatttaccctttcgttttaaatataacaatgtcaccggtgtctgatgttccccttcctgtgtccatgtgctctcattgttcaattcccacctatgagtgagaacatgtggtgtttggttttttgtccttgcaacagtttgctgagaatgatggtttccagtttcatccatgtccctacaaaggacatgaactcatcattttttatggctgcatagtattccatggtgtgtatgtgccacattttcttaatccagtctatcgttgttggacatttgggttggttccaagtctttgctgttgtggggtggggggatgggggagggatagcattaggagataaacctactgctaaatgacgagttaatgggtgcagcacaccaacatggcacatgtatacatatgtaacaaacctgtacgttgtgcacatgtaccctaaaacttaaagtataataataataaaaattttttaaaaaaacaaaaaacaatgtcactataacaaatctgaaaggtgtggctgcttttctcacgttcatgcgttttggcaacttgtagttccttaaggtgtgacggatactctcttcttcccaaatgtactttcttcatctcctttaaacctcacattaaatcctcattatttgctgattccctgcctggaaattgcctacttactaaaatttgtttgtagccctcaaatcaataactcatggagctttcacggttattcatggccattcacagagtggcaaattctcaagtcacctaacagtcacatgaccagctgatgtcaaccaagacaatgctcggcctcctgttccagctctcatactgtaaacaaacatcctttttgtgggacatgtggtgccacattttttgcatttatgcttttggttgacaatcttgctatttaaaatggcccctgggcatggtggctcatgcctataatcccagcactttgggaggctgaggcgggtggatcacctgaggtcaggagttcaagaccagcctggccaacatggtgaaaccccgtctctactaaaaatacaaaaattagccaggcgtggtggcacacgtctataatcccagctactcgggaggctgaggcaggagaatcgctcgaacctgggaggcagaggttgtagtgagctgagatcacgccattgcactccagcctgggcgacaagagcaaaaactccatctcaaaaaaaaaaaaaaaaaaaaaaaaaaaggccccaagagtagtattgaagtgctgtctagtgtttctcaatcagggaaggctgtggcgtgccttacggaaaaattaacgtgttagataagcttcattcaggcatgagttatagtgctgttgcctgtgagctcagtatgaattaaaaatatacattaaataagatgtctttaaacagaaacacatatgcatgaagattgtgggttgatccattgacaaaaaaatgtgaccaggggcttgcaggaaacttatcctgtatttcccccaggatcaatgattcagtatcccctaattcagcgttcaaggtaactttataaaacattgctactctggataagaagaatcacacatgtgtttgtgtcttattccctctgctggagaacactgatgaatgtttttgtatactgcagggctacagtaaccaaaacagcatggtattggtacaaaaacaggcacatagagcaatggaacagaatagagagcccagaaatgagggaacattcctgcaaccatttgatcttccacaaagctgacaaaaacaagcaatggggaaaagattccctattcaataaatggtgcgggataactggctagccatatgcagaagattgaagctagatcccttctttacaccatatacaaaattcaacttaagatggattaaatacttaaatgtcaaacccaaaactataaactctggaagatgacctaggcaataccatcctggacacaggaacgggcaaagattttatgacaaagacaccaaaagcaactgcaacaaaagcgaaaattgacaaatagtatctaattaaacttaagagcttctgcacagcagaagaaattaccaacagagtaaagagacaacctatagaataggagaaaatatttgcaaactatgcatctgacaaaggtctactatccagcatctataaggaacttaaatttacaagagcaaaacaaacaactgcattaaaagtgggcaaaggacatgaacagacacttttccaaacaagacatgtatgtggccaacaatcacatgataaaaaggttcaatgtcactgatcattagagaaatgcaaatcaaaaccacaatgacataccatctcacaccattcagaatggctattactaaaaagtcaaaaaacaacagatgctggcgaggttgcagagaaaagagaacacttgcacactcttggtgggagtgtaaattgttcaaccattgtggaaagcagtatggcaacttctcaaagagctaaaaacagaactaccattggacccagcaatcccattactgggactatactgagaggaacagaaatcattctcccataaagacacatgccaatgttcactgtagcactattcacaatagcaaagacatggaatcagcctaaatacacatcaaggacagattggataaagaaaatgtggtgcagctacatcatgggatacgatgcagccatgagaaagaatgagatcatgtcttttgagggaacatggatggagctggaggccattatccttagtaaactcatgcaggaacagaaaaccaaatgccacatgttctcacttataagtgggagctaaatgatgagaactcatggacacgaagaggggagcaacagacactgggatctacttgagagtggagggtgggaggaggaagaggagcagaaaaacattaagtattgggtaccaggcttaatacctgggtaatgaaataatctgtacaccaaacccctgtgacacgagtttatctgtataacaaacctgcgcacatactcccaaacctaagataaaagttttaaaacaggacgttttctgtaacaataacacatacaaaactctcatattctatacctcctaacttcattctttcataggtaacattatttgctcttttgcttatcgtattatttttaaaccaatgcaatatctattttaaaaaatgtaataaagtaagaaataccatactttaactgttatgataattataattctgagccactgttccaagcaaaatggttaaaatatttccatgtaaatgttcatgtaatactttcatgtaaatctcccataatactaggtcaagggttcttaatttctctgtctcttatttaaacatatcaaccaaagtgacaggttctgagagtttgcacctttttaaagtaccacaataatccatccagtggaacatgacacccaatggataagcccagaggagccgtgtgactttcaaaggaaagttctgtcattcaaatctgtgctcattgaatctggactaaaagaatcatggttgaattattcgttgaatattttggtaaatgagacactaaaataactgtatccaaccctgtggcatcttgcttaataaaataactgtctataaaaatgtaaaccccaaatgatcttcaaacacatatttcattgaatatctgaacctgtttccacttgattccttcccattcccactcctcaccgctctctccctttctctttctttttcttctttctcaaataaaaagagagagacataagcagagtgttaaaaataaaggatgatctaaccaatacgagactgagagtcccaaactgctgctaaattactcaggacattagagtcagactatgcctagaatagaaaaagggcaattttcaatctttttctccccaaaaggcccagcaacatggggaagaaaatagtgatcatttgcttaattgtctgatcctctgatcactaatatggaaagacacattcacagatattctagaacatgccatgtggtataatagaaggaacaatggcccatgagtttgaagaccttgggttctggccttcctgttaactatgatattggatgagtctctagaccatcctgatttgctcacctgtgtaatgagaataaagatacttggtgtgtctattccataggactgaggtaagaattcttggagatgatgtgttggagagttctgtgttaactacagacggaaagtaatgtatggaattactagatatattgtactttcaggtcactgcataagtttctactcaaaagaaaattatagcaagttcttttataaatgaaatatccttttgaagatcattttgagtatataggttttttttttttttttttttgagatggagtcttgctcttttgcccaggccggagtgcagtggcgcgatcttggctcactgcaagctctgcctcctgggttcacgccattctcctgcctcagcctcccgagtagctgggactgcaggcccctgccaccacgcccggctcattttttgtatttttagtagagatggggtttcaccgtgttagccaggatggtctcaatctcctgacttcgtgatctgcccgcctcggcctcccaaagtcctgggattacaggcgtgagagtatatagttttatatagagttcttttttaagtgagataccacagggttggacctagagttatcttagtgtctcatttgacaagtgtctcttccttgtagaactgcaatgaatttgcactgccaagatttgtaaacaatatcgattaattacatgtgtctgttgcatcttgaatatactgccaatgatttttaaatatttttttaaattatctcaaaatatatttcaatttaaaacatgtaactagttttattaagtgtttaatggatacctcagtgtcattaaactatatttttaattttctatttaattattaattctttctgttccctcattccttttatttgtgttatcacttatcttgctacccaaacgttgcatacaattaatcagctgatcactattttctatcagtagcttccccatgttgctgggccacttggggatacaaaagattgaaaactactctttttctattcacatatttattcaacaaacatgcactgggtgcctactatattggtgatgggattgggagtatagacaaagcttctatcctcaatgaggttacattatagagaaatactaagcaaaaaatgtcttggacagggcagaaaagacagcactgcagttgcacccgcacaggtgatgtccctcaagaacgcagttcctggagctgggaccacgttaattcttctgtctacctgcagagggcgccattgcaccaggtacgctttcagtctcacctggtaaaactagaagatggcagctttacaaagaatttcaagaatcctaaaacagtaaaggggtcttatgtgggctaattgcatgaggtgctgaacttaagtatcttcagttgctggagaaaagcagaaattctgcgtttaaggggagaaaatggaggaaaagtgagacaggtgtgtgtggatactggatgtattcatttgtttcaccttgtgcccggcttttcctaaggcctggagacccggcgatgaacgcagttggctatcattgctctcagagggcttactttgtactggtctgtggtgtgacaatgtagaataatgtgaataaagtaataacaatgtccaaaatttattgaatgctttccatgagccaagaactattcaagaatttcacatacattatcttgtttaaactgcacagccgcgcgttgagaagaggtgctatcaactttcccattttgctgatgaggcaatttaggctggatgagaggacgagactgagtactactttcttggtggaggcgacagtcaaagccaggcattagaccggaatcgactcagttaaccactaggctgtgtgtgacagctggaggttagggaacgcggaggcagagagagggaagcagcgggtgcaaagggcagagctacttcggattttatgacggtcaaaggcctcaatgaagaaagaggtaacatttgtttttgttttgtttttgagacggagtcccactctattgcccaggctgtagtgcagtggtgcgatcgcggctcactgcaacctccacctcccgggttcaagcgattctccttgcctcagcgtcccaagcagctgggactacaggcgcccgccaccacgcccgggtaatttttgtatttttggtagagatggggtttcaccacgtcggccaggctggtcttgaactcctgacctcaggtgatctgcccgccttggcctcccaaagtgctgggattacagacgtgagccactgcacctggcgagaggtaacttttgaattgaaatctaaattgtaagagggaatcaactccaggaatatctagaggcagagagcaccatcggtacagcaagggggactgccctgagcagaaaataagcagggaacgtttcagaaaaagtccaggaatgggacaccagcagcagggtggctagagctggagggaagggagaggttatgtcagggctgagccgggagcctacggagccctggctaggggctcaggttcgctatcgcaatggaaactcctgggagctgtgagagcagtgatatgatgggatttacacgtaattatttctccgcttctaggaggcgactggatggtaaaagcaagagcaggtagcagacttttaaataacaataataatcgtggtaatgatacaataggaaaacaacacagcattggtgttatcttgatcggtgaaatacattagttttttgttgttgttccaaatcagcccacttggttctgttacttatctaactagagatcagtctgatatgacgcatggtgattttgaaataccagcacagaacatccctgagatgacggtgatctgaaaagagccctggccctgttcttgtagtgtcccctcctccatcgcatgcgcacactagaggctgatggtggttcgcggatgctaccaagaaggtacaaaaagctgattttacagggatttgtctgacccgtgtacaattatctctcagagtttccaccttttgtttcttcactcctcctatttgccaaaacagtcactggtttgcagagacttccctccccacactctgccctcccgtactcagtcctgcaaaacggagcttgtgtcaaatgaaacaatctccgtttcctggtggacatacttccttgatctctggggcttctgcccttcttttttttttgagacggagtctcgctctgtcaccaggctggagggcagtggcgcaatctcggctcactgcaacctctgccttctgggttcaagtgattctcctgcctcagcctcctgagtagctgggcctacaggcgtgcgccaccacacccagctaatttttgtgtttttagtagagatggggtttcactatgttggcccaaatggtctcgatctcttgaccttgtgatccgcccaccttggcctcctaaagtgctgggattacaggggtgagccaccatacccagccttgcctcctttttagaagaagattatgataatactaacaatagcttgaagataataatgagaataatgaaaataagtattgcttaaagttaaaaataatgaaaataaataatgcttgaagagaatgataatgaaaatagtaacagcaacaataataataatagttaacatttcactagcatttgccatgtgccaggcactgtgattgtgctttatagattaattatttctccaaacaaccctgtgcagtgggtgtattattgttacttctatttttcagaaaaggaaactgaggcacagagagtttacaggatttgttcttgttgcacagctaataaatggctgcattggaatttgaacccagttgtctgggaagagccattctaatttggagaaatatttagtacaatctctgatcaaggacaaatcctaaaatgtagcttggagagcagtttaatatccaatggcaagaaccgccattcattttgcaccaacctaatgcatactcctgctgaaaaaaagaggcctacgatattcttgagagtgcaaggaaaggatagtgacatcacctgatcaatgcagaaagaaaggattatagtgagacaaaactttgcaagactcttaagaaacagtggctttaacttcatcaaatttgctacctgctcttagttgagtaacaagtaagtcatctgtcctctctgagccagattcctgaaaaacaggtaatttaattatttttttccagcatcactgggggggtggttatgaaaattgaaggaaattatcaatgtaaaagctttctgaaagcttgtaacatattatgcaaatgtaagattaactatatctgcaatgcaactgattatcagttctttagtgaagtgtaatgataattctaagtgttacttcagattcaaatgaacatataattttagaaataaactagaatttggcctcacgaccttggccataactttcttttttataataaccaaccatatatttatattcagaatctctctataatgcatctatttcttcaagctatatttaaaatatattaagtaagaaattaaaatgaagtcatttttttcaaacgtacaatgtaattttatattaaattttaaagctaaatgcattcattcagtgattaatttgtttaatgtgccaggcaatattccaggcactaagatagagatatataattcagaccaacattcttagtctcctaattccttgtgttaaatggaggaaacaaataagtaggtaaacaataattaattttaatattttgctatacatttcacaggtaagtggataacccccatgactttgcaattcaaatttagtgtgtcagacacttccatatatgttatctcctgtgaagttcagggtagctgtgtgagttaaaagaaccacacatttaatttgttgctttcttattagatggctcagaatggaaaagggttggcgaaagttttcagagctagaagtgacagagccagggctggaatagaggctttagggcaagaagttctgagaagaccccagagactctgagaggacgggaggatcttatcatcactgagcaagatactgccccaggggtggtagtttatggtttttattcctcacactgcttccttatttagtgagcatgtaagttaattaaatcagagtatgtataatgcatcatataactctatgctaatggttcccttagtatatcttatgtttctcttatgtactttgcttgcattctcttctgaggcccctagtaatgacgtgtccttttagaatatgaaattaaaaccaagtattctaaattgctttcatcatctggaaattttgatgtatttttgacatcttacaattatgtcccttaaaatttctctagaggttctagaacaagggctatttttttgtatgctcacttgactgcaatttcaagctatggaaataagtgatcaatattctcccaagccaaaagccccgtaggacaaccataaagctcctcagtgaaattcagaaatggtcatctaaaacgttgcttttcacagccctacatttttctttcttactgctgttaagttgagcctaaagctgtcttcttacatattttaagttgggcctaggggtttctccatacataataaactggaacctaactgtatgtgtaaacaacctactcttgtaccaatcactgagttttggtcaacaaaaggcagctcactgttgaaactgtgtcaaataaggaaaatgtcaagctgaaccaatctggctgtttcttttcctcacttctattttccatgagccgtgttctgttttctgtccataaatctttttcaaccacagtctctctgaacctattctgatttggggctgcctgatttggaaatcattctttgctcaattaaactctgttgaactatttctctaagatttttcttttaactatcaatctgagtatagatacttagtgtctttagagctaaatgtgttgcaactagatcacataataaatttcaagaatcaagaacacttatttattcattcactcaatacatctttttgaatatctagttaagtgataaatactgtcctaggaactaggaacgctaagataaataagatgtagttcttgaactcccaagaggatcaatccagtgaaatagacagctgactgacccagtcctcatgaccaccatctactgtggggccagtgaaaatcgaagaaggctttcctaaactggcaatacggttgttgagtcttaaaggacctagagtgttaacatagccataaactttctacgtgactcagtttttctttgattaacttatccattgcattattaagataaatccattaataatgaatagttgcagtaaagacatctttaagaaaacgattttgcttttaagtaaagcagcaggtgagtttttatatgtaagagctcgtcaggagttaattttctttctcttccctgattcatttagcttatgttaaaccaggcatatttctcccatagtatttaaaaacaaatatttaaccacatttctctgaaaattatttaggaataggtcttaatatccttctatttgaaatgagagccttcccttattagaaaaatcttcatgatgcttagaaagactgcattaaaaaaaaacaaaactccaaaacttgagaatatatagtcctttaaatctgcagttccactgaacaacctaaaaagttctgtgaatacccacagaggaaaaggaaacccagttctattttgcaacttccattgcaatttcttccttgaaatttttaattattttgagtgagattaaaagttactaagcatatgagattgaagagtttttcataactgatatattattgttatgtgtcattttaattccactttgacttgaacttcaaaattaatcattgtaaaacaatcagtgcttatttgggcattgatcaatttcttttatccaaactgcttctcgaatctcattccttttttcttggtttaatttcctgcttatagaaggctatttttagtagatctcttagtgatggtctgtgaatggaaaactctttcaatattggttgtcaaatttaaataatatcatatctggctatacaaatataggttacctgatattttctctcagtgccttgaaactattcttcatttctgaccttcatgagtgcttatacaattttggagataggctacgtatttattcttttgctgctttaaaatcctcctttataaaagtaaagtctctttttccttgagtttcttcaagtttggggaggtgcatctattggcagactttacattttcaccaactgtaactagcgctcagtgtctttcaaaatttgaggatttatgtccttgttcagttctaaaaactacctcaactatgatttcagtaaatactgcttgtttcttgtgctctcctactgaaacccctctcatgtgttctcttctgggtctaacatcctttactctatgtgttttaacctctcttccatattttccatctccttatgcaactgtgcagcattctagatctttcttccaatttacttgtgcactgaggttttaattataacgaccatatttatttgtataatatttgtattattacaaagcctctttggttgtttatcaaatcttcctggaatttttcctgatttttttttctaatattatctagctctcatatcattttttgcgggtaattttatataattttaatggtctaaaaatattatttagattattctaatataaatttcttgtcaatctgtttacttttctttatgatacagtgttttcttgggtggtttctcattttcgttgctagctcaccttcagaagaataggttttcttatgggaattccatgtgcaatggactaggaaacaatattctatagcaattttagctttactttttccaggtgatatagtttggatatttgtccccacccaaatttcatgttgaattgtaatccccaatgccagtgatggggcctggtgggaggtgtttggaccatgaggatggaacagtccgtcatggcttggggctgtcccatgatagtgagttctcgtgagatctggtcatctaaaagtgtgtggcccttccccctcactctctccctcttgctcctgcactatgtgacatgcttgttctcttttcaccttccaccatgattgaaagctccctgaggcttcaccagaagccaagaagatgccagcacgatgcttcctgaacagcctgcagaaccatgagccaattaaacctcttttttctttctttttctttctttctttctttcttttttctttctttttagttatactttaagttctagggtacaggtgcacaatgtgcaggtttgttacatacatatacatgtgccatgttggtgtgctgcacccattaacgtgtcatttacattaggtatatctcctaatgctatccctcccccctcctccaccccatgacaggccccggtgtgtgatgttccccatcctgtgtccatgtgttctcattgttcaattcccacctatgagtgagaacatgcggtgcttggttttctgtccttgccatagtttgctcagaatgatggttaccagcttcatccatgtccctacaaaggacatgaactcatccttttttatggctgcatagtattccatggtgtatatgtgccacattttcttaatccagtctatcattgatggacatttggcttggttccaagtctttgctattgtgaatagtgccgcaataaacgtacatgtgcatgtgtctttatagcagcatgatttataatcctttaggtatatacccagtaatgggattgctgggtcaaatggtatttctagttctagatccttgaggaatcactgcgctgtcttccacaatggttgacctagtttacagtcccaccaacagtgtaaaagtgtttctatttctccacatcctctccagcaactgttgtttcctgacttcttaatgatcgccattctaactggtatgagatggtatgtcattatggttttgatttgcatttctctgatggccagtgatgatgagattttttcatgtgtcttttggctgcataaatgtcttcttttgagaagtgtctgttcatatcctttgcccactttttgatggggttgattttttcttgtaagtttgtttaagttcttcatagattctggatattagccctttgtcagatgggtagattgtaaacattttctcccattctgtaggttgcctgttcactctgatggtagtttcttttgctgtgcagaagctctttagtttaattagatcccatttgtcaattttgtcttttgttgccattgcttttggtgttttagacatgaagtcctcgcccacgcctatgtcctgaatggtattgcccaggattacttttagggtttgtatggttttaggtctaacatttaagtctttaatccatcttgaaataatttttgtataaggtgtaaggaagggatccagtttcagctttctacctatggctagccagttttcccagcaccatttattaaatagggaatcctttccccatttcttgtttttgtcaggtttgtcaaagatcagatggttgtagatgtgtggtattatttctgagggctccgttctgttccactggtctatatctctgttttggtaccagtaccatgcggtttggttactgcagccttgtagtatagtttgaagtcaggttagcgtgatgcctccagctttgttcttttggcttaggattgttttggcaatgtgggctcttttttggttccatatgaactttaaagtagttttttccagttctgtgaagaaagtcattggcagcttgatggggatagcattgcatctataaattaccttgggcactatggccattttcatgatattgattcttcctatccatgagcatggaatgttattccatttgtttgtgtcttcttttatttcgttgagcagtggtttgtagttctccttgaagaggtccttcacatcccttgtaagttggactcctaggtattttattctctttgaagcaattgtgaatgggagttcactcatgatttggctgtttgtctgttattggtgtacaggaatgcttgtgatttttgtacattgattttatatcctgagactttgctcaatttgcttatcagcttaaggagattttgtgctgagatgatggggttttctaaataatacaatcatgtcatctgcaaatagggacaatttgacttcctcttttcctaattgaatatcctttatttctttctcctgcctgagtgccctagccagaacttccaacactatgttgaataggaatggtgagagagggcatccctgtcttgtgccagttttcaaagggaatgcttccagtttttgcccattcagtatgatattggctgtgggtctgtcataaatagctcttattattttgagatacatcccatcaatacctagtttattgagaatttttagcatgaagtgccgctgaattttgtcaaaggccttttctgcatctattgagataatcatgtggtttttgtctttgtttctgtttatatgatggattacttttattgatttgcttatgttgaaccagccttgcatcccagggataaagccaacttgaccatggtggataagctttttgatgtgctgctggattcggtttgcccgtattttattgaggatttttgcatcaatgttcatcagggatattggtctaaaattctctttttttgttgagtttctgccaggctttggtatcaggatgacgctggcctcataaaatgagttagggaggattccttctttttctattgattggaatagtttcacaaggaatggtaccagctcctctttttacctgtggtagaatttggctgtgaatccgtctggtaccggacgtttttcggttggtaggctattaattattgcctcaatttcaaagcctgttattggtctattcagggattccacttcttcctggtttagccttgggagtgtgtatgtgtccagaaatttatccatttcttctagattttctagtttatttgcgtagaggtgtttatagtattctctgatggtagtttgtatttctgtgggattggtggtgatataccctttatcattttttattgcatctatttgattcttctctctcttcttcttgattagtcttgctagtggtctgtcaattttgttgatcttttcaaaaaaccagctcctggattcattgattttttgaagggttttttgtgtctctatttccttcagttctgctcggatcttagttatttcttgccttctgcaagcttttgaatgtgtttgctcttgcttctctagttcttttaattgtgatgttacggtgtcaattttacatctttcctgctttctcttgtggtcatttagtggtataaatttccctctacacactgctttaaatgtgtcccagagattctggtatgttgtgtctttgttctcattggtttcaaagaacatctttatttctgccttcattttgttatgtacccagtagtcattcaggagcaggttgttcagtttccatgtagttgagcgcttttgagtgagtttcttaatcctgacttctagtttgattgcactgtggtctgagagacagtttgttataatttctgttcttttacatttgctgaggagtgctttacttccaactatgtggtcaattttggaataagtgtgatgtggtcctgagaagaatgtatattctgttgatttggggtggagaattccgtagatgtctattaggtctgcttggtgcagagctgagttcaattcctggatatccttgttaactttctgtctcgttgatctgtctaatgttgacagtgggatgttaaaatctcccattattactgtgtgggagtctaagtctctttgtaggtctctaaggacttgctttatgaatctgggtgctcctgtattgggtgcatatatatttaggatagttagctcttcttattgaattgatccctttaccattatgtaatggccttctttgtctcttctgatctttgttagtttaaaatctgttttaccagagactaggattgcaatccttgcttttttttgttttccatttgcttggtagatcttcctccatccctttattttgagcctatgtgttgtctctgtacatgagacgggtctcctgaatacagcacactgatgggtcttgactctttatccaatttgccagcctgtgtcttttaattgaagcatttagcccatttacatttaaggttaatattgttatgtgtgaatttgatcctgtcattatgatgttcgatggttattttgctcattagttgatgtggtttcttcctagcatcgatggtctttacaatttggcatgttttagcaatggctggtaccagttgttcctttccatgtttagtgcttccttcaggagctcttataaggcaggcctggtggtgacaaaatctctcagcaattgcttgtccgtaaaggattttatttctccttcacttaggaagcttagtttggctgcatatgaaattctgggttgaaaattcttttctttaagaatgttgaatgttggcccctactctcttctggcttgtagagtttctgctgagagatcagctgttagtctgatgggcttccctttgtgggtaacctgacctttctctctggctgcccttaacatttttttccttcatttcaactttggtgaatctgacaattatgtgtcttagagttgctcttctcgaggtgtatctttgtggcgttctctgtatttcctgaatttgaatgttggcctgccttgctaggtaggtgaagttctcctggaaaatatcctgaagagtgttttccaacttggttccattctccctgtcaatttcagatacaccaatcagatgaagatttggtcttttcacatagttccatatttcttgaggctttgttcatttctttatactcttttttctctaaacttctcttctcgctccatttcattcatttgatcttcaatcactgataccctttcttccacttgatcgaatcggctattgaagcttgtgtatgtgtcacgtagttctcatgccacggttttcagctacatcaggtcatttaaggtcttctctacgctgtttattctagttagccattcgtctaatcttttttcaaggtttttagcttctttgaaatgggtttgaacatcctcctttagctcagagaagtttgttattaccgatcgtctgaagccttcttctcccaactcctcaaagtcattctccatccagctttgttccgttgctggcgaggagctgcattcctttggaggagaagaggcactctgatttttagaattttcagcttttctgctctggttactccccatctttgtggttttatctacctttggtctttgatgatggtgacgtacagatggggttttggtgtggatgtcctttctgtttgttagttttccctctaacggtcaggaccctcagctgcaggtttgttggagtttgctggaggtccactccagaccctgtttgcctgggtatcaccagctgaggctacacaacaacaaatatttcagaacagcaaatgttgctgtctgatccttcctctggaagcttcatctcagaggggcacccagtcatatgaggtgtcagttgacccctactgggatgtgcctcccagttaggctactcgggggtcagggacccacttgaggaggcggtctgtccattctcagatctccaactctgtgctgggagaagcactactctcttcaaagctgtcagacaggggcgtttaagtctgcagaagtttctgctgccttttgttcagctatgccctgccaccagaggtggagtctacagaggcaggcaggccttcttgagctgcggtgggctccacccagttcgagcttcctggccgatttgtttacctactcaagcctcagcagtggcagacacccctcccccagcctcgctgctgccttgcagttcgatctcagactgctgtgctagcagtgagcgaggctccgtgggtgtgggaccctccgagccaggcatgggatataatctcctggtgtgccgtttgctaagaccattggaaaagtgcagtattagggtgggagtgtcccgattttccaggtactgtctatcacagcttcccttggctaggaaagggaattccccgaccccttgtgcttcccaggtgaggcgatgccccaccctgcttcagctcatggtccgtgggctgctcccactgtctgacaagccccagtgagatgaacctggtacctcagttggaaatgcagaaatcacccgtcttctgcgtcgctcatgctgggagctgtagactggagctgttcctattcagccatcttggaacaagaaccaaaactcttttctttataaattacccagtctcaggtatttacagcaatgcaagaataacctaccacaccacgtattccaagggctcgaaagcctgaacccagtttttatgtttatttattggcttggtgattcctgacatcatacttacgcatagcacaggcttggggttttacttcttctaagatactaacttgtttctctttccacttccttattgcttccctgggttggttggcatagttataatggcttgacgttgaggtcctgtctttcttctggggtctcagtcactactcctcactacgtatggtctccaagtcatgttcactgtcactttgggagcattactcctcattcccactcctagtggaatattaaatccagtattctcccagacctctgcaggctttcaaacttatcactcttcatttaaattcattcttcgtttctcacatctagttatatattttctctgatacacctagtaatgtattgttacatttttagctaccatttctttgtgtctaaagaaatagggcatttgttttagttctgacaaccctttatgttaagggtcaatagagccatcgaaatgtttttctctccagattttattcatcagaaaggctgctttcctttaggaagttgtcccacaaaatggtttccataaattcaatcaattggtaagacagaaggtctcagttgaaaactatttcaaatgcaaactactaaaaccatcagggaggtaaaaatctaatgtttcttgtcaactatatagaaaaatatgtttttgtaaacaattggttgagtttaaactacaaaaaactacaaataagaagcattacaactatttagacatatctctacttactatagaacctttgctgtgaagagctaatctcatggtaatattttgccaagatgatgaaataaaatgttaacttaaaataaatatattttatttggctaccattgttatttctctttttttctggagtacactatcattacatttctttgcacctttaacagggaaattttaggacatgattatatgcatgagccctgggtcacattttaagccacaaaaccagaaagacaagatgtttctaatgtttgatgctgtcccttctattcaactgccatatatgctcatatattttaattttttaaaaatagagacaaacttccactatgttgcccaggctggtctttaagtcagacaaatgcaattacttgattccaagatggtagattactggtttgtttacaatagagagaaactaggaaacaaaactaaatatttaaacaactatgggacatctaaatgacagaacgttatgcaactattaaaacaatgtttttgtagagaattaaatgatattagtaacttatcataacataatatcaagcaaataataggacatacaattgtattttgaagaatatgtatatgtgtttaaaagtagcaaaatgcaacatagtataattttagaaatgctaataattcctaggtcattttaggttgccttgtgttatcttgtattttctttccatactttgaaagttttctacagggaataaaaattacttttataataaaaatccaagaaaaacatattggtgttctgatagcaaagtttaaataatcatgaaggcagagttcagacttttcaagaccatgctgcacagaattatgagtgacaacaacatgggttatgccacaaagaatcagctgtcaaaaagaagaggaaacaaatatatcaaagtaggccagaaaatttgctcatcagtgctgtctgctagaactttctgtgataacagaaatgtggtatgtctgtgctgtccaatatgatagccattagccacatgtggctacagagcacttgaaatgtgactaggagatgaaggaacagaatttttaatttaatttaagtgatatttaaattttttaatttaaatagtcatatgtaattaatggcttccatgttggacagcacaaatctccttcgtcacttaagggttattgcctattcattagtgggaagaataatatatttatatcaatgatatgttaattatatattaaaaataaataattatagataattatagttggcagaactggcctagttattttccccacaacaatgctgatcttcctatgatgagtccaagattttgcaacatttggcttttgctatggtttggatatctgacccctccaagcctcatgttgaaatctgatccccatgatggtggtggggcctaatgggaggtgtttgggtcatgggtacagatccctcacgaatggcttggtgccatcctagtggtaatgagtgaattctctttttagcaaccataagagctggttgttaaaaagagccttgcactttcccacctcacttgtgcttcctctcttgcaatgtgatctctgcacgtcagctctccttcaccttctcccatgagaggaagcagcctgagggcctcaccagaagcaggtgctggtgccatgcttcttgtacagtctgcagaactgtgagccaaataaacctcttttgtttataaattacccagagtccgctattccttcctagcaacactaaatgaactaagatagcttttaattacaacggtggcatctgttactactctgcattctcatcttcattccaggtaagtaaattttaagttttggcttctcttagttccaagacacaacataagtcattccctgtttttgggaggagagagtcaggatggagaaaagaataaaatttattgaaaatttaaaattaagataattaactatgtgaactaaaagtgagtaatataataccttctcccagaaaagatcaggacgggagtgttacaaagctttgacatttcttaaagtgcactctgctgcattttgtgtgtggtctatgtgtaatagctcatcttcaacacacacatacaaacacacactcaagtgtgagaataaaattaacttattttcttatgtaattttggagtaagtttatttagagtcatatgttttgtatttttattgaaatatatgcttgttacctgcagttttgtaaaaggatagcatttattctctctctcttccttcctctgtctctctcaaattgcccagagggattaatcaacagaaatctaaattttagaaaacctgctttaaaagagtacttgttctctattttgagtttatgggacaaatgaaactgttctttcaatgggtgttggcaaagaaggtctggaaaagtttatatgaattgccaagcatggaatattgatcattagccaatcaagctggatgatactggacattatacttagtccacagaagaataatataggtatatggatataaacatatttttaaaatgttgaataagggacagttcagatctttttcaatttcagttcataatgcatggtattttcaatgctccatgcatggctaaatacacaaacatcataaatgattctaaagcatgatagggtgcttgcccttaaaaattaccagtagctaacacttttgccagttcagggtacaaaaaaaataaagaccaggagatgctaaaatgatccatatcactatggttataaactttgaaacttacaatgcacaccttaaaatcaaagtttccaaggaaaccaatgaatatattttaagacaagaataatatgatttgcaaatcaaaatccatttaagactgttgccacagcactatgtgttgattggtgcttgccatatttttttaggaagtcagaaaaaaaaatcttatgttccatgaatccagcaataactaagactgcaaccctgattttcttacccgtctgccttgttaacatgatatatgtcaaacataatgaagaatatgtaaaagaacccttgttaccaacaaagattttgcaatatcttcaatacagagaatagaagaaccagaaagaagcagcgacaggtaggcggagagaggaagggaggaaactactgactgagtaaccatgtatgattgggaataaaatgggatctcaaaatcagattccattttgcacccaaccacaactgagaaaactgaggctcaaaaaagtgaagtcattgacacaaggtgttgactattaattgctgagtcaggatatgaagcccagttagtctgattccaaaacttatattcttcctggtggatcagacagaaggaatgggaaaatgcaatgcactcagggtgctcagtggaagcgttggagtgtggagttcaagtcctgagcgaatgtattcctggataaagaattagtcatcaggggaaggtcatgctggagctacgctgaagggtaaagtttgtttttggactctacctgtttcctctccttggctctaagatgacatgcaccagggatctcacctctaatcccgccattgcatgaagagaatgccttgcacatgactagatgctcaacaagtatttgtaaatgtgcatcttaaaaattggtcatgtcagttacgatgtgaaattcaccagtgaaaatgctagctggggctttgaacctggagctactaatttcccaggttccatctcataccatctgcccggcatagtcctaccacccatattgccacactggttttagcagggcaatcctctgaaagtatttttgctacagtggcttgaggcatagtaatactagatggagactaggaactctaagcaaatatctataaagttcacaacaaggctgtgttgatcactctggaaagaggtggtgaaacgattctctttgatgactcctcctgtgtctgcgtatctgtgctttggatagcccacacaggtacatcattaaatgccctcccagggtactgcaccagcctttgagcaggatttaaccttcagagtgcactcagcaattgcaaagtagtgtgctggtgactccattcccagacgtccctcttgacacactgaactctagagtgtttcatctcgtggtatgaaccaagaattggaacagtcacttgggcagagggattctaggtcctccgtataacctaagcaaagacatttttcttttccaagctagaaaaacatgcctaaaacagaaataagtataagcagtctttgcaagccttaccatttctacctccctctggggaatccaacctgtggtatagcactggacctggacaaatagcacagtgatctactaggagtacaatgtgttatcactgttgcttttattataacagctggcagctggccaaagctttgcaaagaaaccagaaagcaacagcagggcactgggctgccttagaaaaacatttcttggctcaaagaggagcctctttaacaagaacccaacacctcaaacctagcaaaaaagcatagctcaggtcaatcacataaaacacagcttcacaaaatctgtcccataacaaagctagaaatacaatggtgtaataaatttggtatacctaagagcctgagaaaaggtacagctgcttaagaataagttatagaaaatctttgttaaatactctagggaaggattcaggcatcttcctacttatctaactttttagtgtattctaaacttggccaggaaggagaggtgtgatcttggcttggtgattcctgtagatctccggactttggctgcctcacctttacctgaaactgttgaatgggatgctagattccctccagctctgacattccatgactaaagaaagtcaaggtttaacactgaccttgacatcctggggcaatggagagttttagtgtatgcaattgtcatgcctgaaaaaatgtcaaaacatggttagggttcctctccttgttcaggagaataaaatagtatattttaaatatgctagtataaatcttataaataaaatagtataaatctcccttctgttaagagaatgtagaaataaaataaataaaatactaaatactaaatagtattagtatagtaaatagaaataaaataaataaaatactaaatcgtagaaataaaatactaaatactaaaataataaaatactaaagtttgctcaaggaaaagatgaagttagatatgtgtttccttttaaggaggttttcatgaaagaattttttttggcagatcacttgagcttaaaaggagtattgttgtttcagaaatagcacaaaaagctgttccccaacaagggatgcagcagaggcagaatgtttaccacctagggtgttagtgaaaggccctgtctctaaacatcccacgttgagataacttcaatgtttgatcaaaaagtaaatcttatcccgtaataagtgagcaacgttctgtttcccctcacccctcaatattgaagcaatgacaagataagtcctctcctgtagacacatttaccaaccaagtgaaacatggcgtcttgtcggccttaaccgctagacttgagagaatggaattttcatgaaataagagtgccgatccataaaatacatgccattcgttttgatttaaattataaacaatcttatccatggtcttcttttatttttattttttaattttcccttccattctttgatttttaaggagtctccttacaaagtcagaacagtttttgtttttaccatagccaccatggttaactttttctttagaaaaatgttcagtgatatccaagggcagaaaaccaaacaccacatgttctcactcgtaggtgggaactgaacaatgagaacacctggacacagggcgaggaacatcacacaccggggcctgtcgtggggtggggggaggggggagggatagcattaggagagatacctaatgtaaacgacgagttaatgggtgcagtgaaccaacatggcacatgtatacatatgtaacaaacctgcacattgtgcacaagtaccttagaacttaaagcataataaaaattaaattaaattaaaaaaagaaaaattttcaatgaaacaaatgcacttcctgaagttactaagcctacacaaatgaatgaatgaacgaatgtctttcctgtagttcttaagcccacatgaacaaatgaatgaatgaatcaatcaatcaacgtctttcctatagttgttaagcctacatttacgtaaaggggagttgctcttacactgacactgtcaaaaccctctacctcccttccactccctccctgccaggtaaaagctccacctaagatagaaggcaacccaggttccaaagtaattcctccctcacctgtgaatgaccagaattattatcctctaagtgcttctattgtcacttgaaaaaggtacctgcttacctgattcaattaattcacaagaaaactaggaggaccgcttggtttacccaaggaattgggactaggaaagtttgttaatgtgaacaagccacctaaatctgtgattctcaaagaaagacctgaattccattgctctgaggactagaaaacagcccagggctgcaagtgtttccttcaggttgcagggaaacaacatgcaaaaaggttatgctaacatttggaacgcacgaactaaatttgcttgttaataaaatttcctgagacctctaattcggactttcctagaaagtctgcctgtcacatcatacgcagcagaatcacaaagttgtgaatgcacacgtccttggataattgggattccagtaattttccattccaagaggatgttttattactgctcctcagtgttctgagttggtcatgattttcagagactgatgtttatgaatttaagttgaaaatttatgtttatgttatcctcatcaatttagtttgttataagttgtttggtgaatcccatacagtgcaatgaagcatatttgcatcaatgacatttctagactataaacttccaattatttcaccaataaaatatgtatactttacagtacaaatgcgagttatccataccccatcttctgaaacaaatatgtctgttttccttgtatattcccacccctagtctacaattttgcctatatagtgtcactttattattatcgctaagttatttttctacctataacttacctagagtaagataacacagccatggaatcttttaccctacctaaatgtgtcataacaagatgtctttgaaactcagctctaaatgctagcatggatggaaaactatggttccatttgcaaggctggcttacagagcacaaggagatacagttatgaaagggctggactacgacagaagtagtaggccaatagatctatatagtcagctttttgtcatgtaatttattaactatgacacaaatgcatttaagaatatcaagtatttctctggctcttgacacagttgacttaaccttttgctgtctaaggaactgaggctttcctgttctgggtgctactggcaaatgttctagtacttgaagtcgggatgcacagcttcaaccactgacttatcagtgcagccacctgtgtattgcaactggccattaaattaaacaccgagccacctgggtttagttcggtcacttccataagtgtatttagcattggtagccctgctttattaaagtgcagcagacgtgctcttctgtcccttctgtcccttctgtttgtggttctttgggaaagttctgatatttgcttttgttttgtgcttgctttcgtgtttttatatcttgtatttatccctgaacatatttcgaacatttttttaaggaaagaaattcttttgtgtatatatagatacttgcatgatatactgtcatcaagtttcggttcctcaaaaggtcttggagctgtcaggtgtgatgtactccaaccatcaaagttctgtggaacacggtttgtatgtaaataaatgtggggcgtttggcccttgaaaccggaagacattacggtaggtgaaataagccagaaacagaaagttaaataacgcatgtgctcattcatatgtggaagctaaaaaatagttgatcttacagaagcaaaaagtagaacagaggaaactagaggctgggataggcaggaggaagaggggttagggagaaattggttaaaggatagaaatttagagctagagaggaggaataaattctagtgttctgtagcactgtaacatgactatagttaacaataatgcatggtttcaaagagctagaaagaggatactgaatgttcccagcacaaagaaataatagtgtttgagataatgaatatgctaattaccctgatctaatcaccgtatattatatgtattgcaacatcactatgtaccctataaatacatacaactattatgtgtcaattaatttttttttgagacagagtctcactctgtggcccaggctggagtgcagtggtgtcatctcagctcactgcaacctccgcctcccaggttcaaggggattctcatgcctcagcctcccaagttcctggaattaaaggtgtgtgccacaacgcccaactaattttttttatttttagtagagatggggtttctccatgttggtcaggccaggcaatgatccacctgcctcggcctcccaaagtgctgggattacaggcctgagccatcatacctggccaattaaaaaaaaattttttttaaagaattctctagttcattcctactatattctgggcaaaagctaaacatctgtgccagacgcatttattgtctttctctctctcaatctctctcctttcattgaagcttccctttaattcccaaataaatccaactcccttccatattgaacaccataccactgactcagcatcatttacatcttgcagggaggttctttctctgtctttttccccttatctattcatccatccatccatctctttctctcatttcattgccaaatatttgggaaagcagtccaaggttactgctgcctttgcttcttcacctctcatcctctccctgaaatctgatctccctacatctctcattttctctcttgattcttcttctggtgatttcttcttaaatgttaatgttctctaggttccaacttgggccctctttttgtcttagtctacatgtcctctctgaatgatctcatccacgaccatggctttaactataacctgactctagtgattcaaaaatctttctgtccaacaccaatctcttgtctttactttagaattggatagccactgcatactgggtgcctatagctaaacatccagctatctgtaagtcttgtaaacacaacaacggtatggaaatccaactgaaaaacactcatgcccagtggaccatgaatttaaggcaagtctgatggtgtgagaaaagcataaaacccagtcagaaaccttgggttccaatcccagctcaattgtttttagtcatagggcaggtcctctatctatctgactgtgatttttcacttgtagagtatggcttactgtactttaaagattttctggccgggcgcagtggctcacgcctgtaatcccagcactttgggaggctgaggtgggcggatcatgaggttaggagatggagactatcctggctaacacggtgaaacctggtctctactaaaaataccaaaaaaaaaaaaaaattagccaggcgaagtggcaggggcctgtagttccagctactcgggagggtgaggcaagagaatggcgtgaacccatgaggcggagcttgcagtgagctgagatcgtgccactgcactccagcctgggcgacacagcgagattctgtctcaaaaaaaaaaaaaaaaaaaaaaaaaaagattttctgtgagggattaaatcagataatgtatgtaaaggtgtgatgtaagctggtaagtgttattccaatttctgatatgctattatttaaaatgtagttggacaagcaggagtaacatttaaaatgagacaaaaagtacaagccaccagaaatgcaaatatcaaattaatttgtcccagtaaactaaatataaatagtttttacactttaatgtacatctgaaagagcttattaataatgtcaatgcttgagctacagcccagatttaattggttgggaaagaggtcagtaatctttacttcaaaatcattccaattgtcacaggcaagtcagggccacacttcaagaaatagtgaaatataatgcacttgagggatggtcaatcctcaaaatattctaaagacttgtaaaggcttcagaactagttccttcttgagaagcacattgcttcttttgctgagttcaaattgtaatgaatttcaaggcttccaattctgggcttcttacataaagcaatcattccttcctcactcccaacacaaacacataatttttaatatataaataaatatatatatttacatttgcatattctgttttcattaatggaatttttttcctgtatactacatgagtaataatgtaaagacacgaaataaaacagacactaattaggcatgtttgaacatctgttgctaccaaacattttctatttctcttttcatatctctgctgatgggtttagatgaaaagactacaagcctgcatacttacagggaggaaggagccaaactggaaaaccagtagcacaggtcggtaggaattaatctcagcaggctcgcttcagcattcggagacacaaccagcaaaacacttccaagctggtggctcagttaatatgtgaagctatttttagtacaacagagagcatttctagagattgagattataaaccagggatacatcccaaacatattaatatggttttaattttattttacagataccatgtttcagaatattttaatctccatgtgaataattgtttttattttgtatgtatgcatgatgtaagtatgcatacagtacatttatatgcacgagcattattcatatacatgcatacctacatgtaaaaatctgggtaagagagtaaatcagatgttttagtccttgtatatataaggtaaaagccagaccttttaatgacttacacatttgatcaggaagttttgtgttttgaaatgacaaaaacttggaatattttcgaaaggagtagaatactttcggccataattttcatttttaagatgccttaaatgttttagttccttttaataaataatcttacacaatgagttggttctcactgtcgtattaggtaaatgggttttgttgttgttcgtttttgctaaaatgggttttgttgttttttgtttttgctaaaacgaaaaaacttcctttttattaaggaagttatatgaaagtccatcacttccacaaattaggaggctacactactgcaatttggctgaatcagtggatatttttaatgttgcttattttgtgctttaaaattgcagttatcccagagcatctgtaattttgttttttttttattttgaacaaactgttatctgttaaattaacaataagaaaaatgttattttatctatgtttattcattcttcaaaattcttccttttgttttttttgtttttttaattttcttttttttattattattatactttaagttttagggtacatgtgcacattgtgcaggttagttacatatgtatacatgtgccatgctggtgcgctgcacccattaactcgtcatctagcattaggtatatctcccaatgctatccctcccccctccccccaccccacaacagaatgatgatgagatattcctggtaagatgtaatgttttatttttcttcctggatctatctctgatcttgttccagggcacatcaatttagaaacactcatcgattatgatagctttgagaacaaacattggaacattaacatgctaattttgttctttacaggttgatggtagaaaatgtataaagtttaaaaacatgcaagtcttattagcattctgcttagataaatacaatcttattttatttctctctccttttattcatgccctgccaattgagagtgccaggtttctctccttttctgtttcacagcagctccaaagctaaagggaaaccaaggtggaaaataattaccccaaaagagacattttccatgacactaatggctggatttcagatactttccaaagctcattggaaagggagaactcatggagaagaaacaaccaactttaagtatcccattactctcagaggttgactcagagcctattccatgtagaaatactgaagagggtgtaaaaaagaacgaaaagcagaaacaaaataaataaataaaaacaacatagtcatgctttgtttatccttctttcccttgcaaacatctgctctctggagtctgctctggcatttaaggagcttggaagtcatccctcccatccaatctcacaaagaaaaaaaaagctgaagaagtaaaaaccaacaattcctctgaaatccctcagaggattgatgtcagagggcaaaccattgaccccatgattggagacaaagacagaaatgtacagagaatcatgacctagagtaacagaaacctttgggaaaaccaacattgggatagaaaaacttaaactgcaactgattagttgttcgaggctcaatgtggattaatttgagcattaaaaactcctttgaggatcagggagcagttttaagggggctaccacacatttgtgacttttacttccaggagccctactaggtttgcacaatgagggtcagggagaaatttcctaatgcttccaacaaggaacagggaaaaagtaaccattccgaaatacacccaggtcactctgttcttcttatggcctgtctcaaaagaaactgtattacccagagcccaacagactgagattatagcagagcctaaaccaccggggagtagggaaatatccaactccagcccctctatccttcccattgcacctaaagaggaaaaacccccaaaacccaaggagcacatgtggagatcatggcccaggggtagaggctcactgtgggactgggtcctaatcatcagattatacaaagcatcccccttcccctgcaccttaccacaataccagtagggctcctgtataataacagatgaacgcaacggaaagaactgtatgacccatgccttatttaagaagaagtttctaggaaaacccaaagacaacagcggggaataaaaacaaggacatcagaggagatgttagcctctaaagcctctagctacagcaaacagtaaacacagctcaattactagccagataaacataaaacctcacagtaatggcctgtatgcctcatttatttagtacatcacatcctactgtcaacaacaaaaaaaattccaaggcacactaaaagacaaaaaacacagtttgaagagtcagagcaagcatgagaaccagactaaatatggaaaatatatgggaatcatcaggtatgaaattaaaaggaactatgatgaaattcaagaaataaaaaacataatagaaatgaagaatgaaaaattagttcatcaatagactggacatgattgaggaaagaatcagtagagtttggacatgtgtcaaaagaaacctccaaactgaaatacaaagagaaaaaaaagtataaaaaagacaggaaatgtcaggcgcagtggctcatgctgtaatcccagcactttgggaggccaaggcagtctgatcacttgaggccaggagttcaagaccagcctggccaacatggtgaaaccctgtgtctactaaaaataccaaaaaaaaaaaaaaaaaaaaaattagcacatggtggctcatgcttgtaatgccagctattaaggaggctgagcatgagaattgcttgaactcaggaggcagaggttgcagtgagccaagatcatgccattgcacttcagcctgggtgacagagtgagacactgtcaaaaaaaaaaaaaaaaaaatagagagagaaagagaggacagaacagaatgtctaaaaactgtgggggtaattataatataaaaggcataacatacatgtaatgggaaaatcagagaagaaagaaaagaacagaagacatatttgaagcaataataactgagattttccccaagttaatgacagatattgttatgagcttaattatgtcctcctgttcccccagcctcaacttatgtcaaagccctaactcccagtaacctcagaatgtggctgtatttagagataaagccattaaagaggtaatgaaggtcacatgagatcataagggtgaggtcccaatccaatatgactggtgttgttctaagaggaagagactcaggagatgggcctatacagggaaaaggccatgtgaggacacgggaaggtggccttctgaaagccaaggagagagcctcaagagaaatcaatcctgccagcaccttgttcttggacttccagtagccagagcacttctaccctcatatttattgatgagataataaatttctattgtctaagccatacagtctgttatattttgttatggtggctctagtaaaggaatccaccaagccacacaacaaggaaactcaaacaacaccaagcacaataactatcagagcaaccacagacatatcacattttgacttcagagaaccaaacatgaagagaaattttgaaaggagcgagggtggatgggatgagggaaaccttacctggagagaaaaaataaaataactgctttgaatttctcatcagaaaccatgcaagcaagaagagagtggggtgatagatttaaagtctctaaagaaaaaacccattaacctagaattctgtatcttgtggaattatcaaaagtgaaggaaaaacaaagactttcttagaaaaacaaaaactgagagaatttgttgacaaaagacctgccttgaaaagaatgtttaaaaacagttcttcagaaaaagggagaatgatataggttgaaactacataaagaaaggaagactattagagaaggagtaaatgtacgtcaaacaaaatctctttatagaaagtttcttaattgatctgatggataaaaaagtgttcaaaatgataccagcaacaatgcaattggtggttatagcctaaaggaaaggaatgacagcaatattataagagataagaaggagaaagtaggaatactctgttatgggatagttgcattacatgttaagtgtacagtgttacctaaaaatggacttggattcgttgtaaatgtatattgctaactctagaaaaactgtaagacatttaaaaggaattataattgatactgggcaaaaagggaaaacagaattatataaaatgttcatttaaaatcagagaaggcagaaagagacaggaagacaaaaggaaactaatataaaacagttataaacattaatgtaacagttatagatattaaaccaacaatattaataaccactttaaatgtgaatgatatacatcaagtaaaagacagggactatcagagtggatataaaacagaaccaactatattctgtttagaagaaacttgctttaaatacaaagacacagattaaaagttaaaggatgaggaaagatatgccatgctaaaactaatcaaaataaagctaaattagataaattaatttcagacaaagactctagaaaaaacatttttcagggataaatttcttttattgcataacaacagaaggttcaattctccacaaagacataacaaccttaatgtgtatgtgcttaacgacagagcatcaaaatacttgaggtaaaaactgacagattacaaagagaaatggatgaacaattactatcactggaggcttccacacacatatatctgtggttgacagatctagcaggcagaaaatcaggaaggacagaatcaaactaagcagcaccatcaatcagctgaatttaatggccatttatagaataattaatgcaacagcaacagaatctatagtcatctcaagttctcatgacatgcaccaagatagaccacattctaggtcataagacacaccttaaaaatgtaaaagaatagaagtctttcaaagtatgatctcaaacaatagaattaaactagaaatcaacaacagaaagaagctggaaaatctcaaagtacctaaaaattaaacagtacacttctaaacaacacacgggccaaagaagaagtctcgggagaaattttaaagtatttcaagctaaatgaaaatgaaaatacatgttatcaaaattcacaggatgtagtgaaagcagtgcctagaaggaagttgaatgcatatattagaataaagaaagatctaaaatcaataatctaaattcccatcttagaaaactagaagaacaaaagcaaattaaatctaagccaaacagaagaaaacaaataataaaaatcagagcagaaatcaataaaattgaaaatcaatagagaaattcaacgaaaccaaaatctgggtgcttaaaacaattaatattgatgagcctctagccaggctaattaagaaaaaaaaaagaagacaccaattactggtataataactgaaaaggaggccatcactgctgatcccctttatcctaaaaatagtaaaagaatattatgaacaactcaaccccacaaatttgataacaaatttttggttcaaaaatttgaaccaagtttttgaaagatacaatctactgaaactcacactaggagaaatagataatctaaataggcttatacttattgaagaaattgaatcaacaataacaacttaccaaaacagaaagccaccaagcccagataacttcactggggaattctaccaaacatttgaggaagaaataatactccgtacaatctcttccagaaaatagaagcagaggaatattttctaactaattctacaaggccagcattactctaataccaaagtcattaaaaaattaccaaaaaggaagactacagaccaatacttctcataaacatagatgcaaaaaccaccaacaaaatattagcatattatatccaacaatgtataaaatattatacatcatgaccaggtgatatttattccatatatgcaagaatggttgacaatttatacattaattaatgtaacccatcacatcaacaggctaaagaaaaatcatgcaatcatatcaatacatgcagagaaatcatttgccaaaatctagcaccagtcatgataaaaacccttagcaaactagaaatatagaggaatgctcccaacttgataaaaaaaaatgcctacaaaaaacctacagctaatatagtacaaatgaaaagtctctcttctccctgccctcatgcctaagtcagagtctcctaaagaaccgaacagctgaggaagctcttcattggagggctgagctttgaaacaaggtgagagcctgaggggccattttcagcaatggggaatgctcatggactgtgtggtaatgagagattcaaacatcaagagctccatgggctttgggtttgtcacataggccactgtggagaatggggatgtggccatgaatggaaggccacacaaggtggatgggagagttgtggaaccaaagagagctgtctcaagagaagattctcaaagaccaggtgcccacttaactgtgaaaaacatatttgttggtggcattaaagaagacacagaagaacatcacctaagagattattttgaacagtttggaaaaattgaagggattgaaatcatgactgattgaggcaatggcaagaaaagaggctttgcctttgtaatctttgatgactatgactccgtggataagacggtcattcagaaataccacactgtgaatggccacaactgtgaagttaggaaagccctgtcaaagcaagagatagctagtgcttcatgcagccaaagaggtcgaagtggttctggaaactttggtggtgatcgtggtggtggttttggtgggaatgacaactttggtcgtggaggaaacttcagtggtcatggtggctttggtggcagctgttgtggtggtggatatggtggcagtggggatggctataatggatttggtaatgatgccagcaattttggaggtggtggaagctacaatgattttggcaattacaacaatcaatcttcacattttggacccatgaagcgaggaaactttggaggcagaagctctggcctctatggtgatggaggccaatactttgtcaaaccatgaaactaaggtggctatggtggttgcagtaacagcagtagctacggcagtggcagaagattttaattaggaaacaaagcttagcggaagaggagagccagagaagtgacagggaagctacaggttaccacagatttgtgaactcagccaagcacagtggtggcagggcctagctgctacaaagaagacatgttttagacaaatactcacgtgtatgggcaaaaaacttgaggactgtatttgtgactaattgtatgacaggttattttagtttctgttctgtggaaagtgtaaagcattccaagcattccaacaaagggtcttaatgtagatttttttttttcacccatgctgttgattgctaaatgtaatagtttgattgtgatgctgaataaatgtcttttttttttaatgtactgtataaagttagtctgctctgaagccatcttggtaaatttcccccaacagtgggaagttagaattccttcagggtgatgccaggttctatttggaatttatacacaacctgcttgggtggagaagccgttgtcttcagaaaccttgctatagttgaactgatagttactgttgtgacctgaagttcaccattaaaaggaaatagccaagcaaaatcataaaattattggttataaaaatgagtgttggcacatcttatgcaatatactaaattgaataatggtaccagaaaaaactatagatgggaatgaagattgtgtaacatctattatcatgtgtaatcaataaatgatttaattctcttgaagaaaaaaaaaactagatgctttcccactaaaataaggaaaaatgcaagaatgtcccctctcgctactcctatttgccattgtactggagtcctaggtaatggaataagacaagaaaaagaaaaaaagggtatatagtttgataaggatgaaataaatctttgttcaggaagacatgtttgtctaggtagacaatctcaaagaaacaacaacaacaaaaactcttagaactaagtgatcatagcaaagttgcagggtacaaaaaaagtcagcggttttcctatgtaccagcaatgaaaaattgaaatatgaatttcaaaacacaatactatttatgtaagcagcaaaacttaggcatacatctaacaaagtatatagaagatatatattaataagagtacaaaattcttttaaaagaaatcaaagatcaaaatcaatggaaagacataccaaatatgtggataagaagactcaatattattaagatgtgagttctttccaacttgacctgtgaattcaatgcaatctccatataaatcctagcatactttgaggatattgacaaaccgattccaaagttgaagtggaaagcaaaagacccaaattacacaacacaatactgaaggaatgcaatgacagagagttgacactaccaaacttcaaaacttactataaacctatagtaatcgaggcagtgtggtattggcaaaagaagaaaaaaaataaatcaaggaaaaagaatagagatttcaggaagagacttagacaaggtagaaaaggtaatcgaatggagagaagatcctattttcaaaaaatggtgctggaacaactagacctctacatgcaaaaaaaataaatatagactccagattttactaatttcacaaaaattaacttaaaataaattatacaactaaaaataaactgtaaaactataaaacctttagaatataacataggagaaaatctaggtgaccttgagtttggcaatgactttttagacacaacatcaaaagcacaatctatgagaaaaaattgtaagttggaatttattaaaatttaaaactttgattcttttaaatacaccattaagacactgaaagacaaactacagactgggggaaaatctttgcaaaacgtatctgataaagcactggtatccacaatatacaaggaactcttacaattcaacaataagaaaacaacacaattaaaaaatcggcaaaatataatatctgaacagaaaactcaacaaagaagacgaacacttggcaaatatgcatgtgaagaggtgctcaatatcatatgttattagagaactgtaaatttaaaaaacaatgagataccacatctattaaatgactaaaatccaaaacattgaaaacactaaatgctggtaaggatgtggagcaacaggaacttgcattcattgctggtgggaatgcaaaatagtgtagccactttggaagactggaagtttcttacaaagctaaatatactcttaccatatgatccactttcctaggtatttgctcaaatgaattggaaacttatgtcttcaaaaaaattctgtacatgaaggtttatagcagctcaactcgtaattgccatatgtggaattgattaagatgttcttcaatgggtgactggataaactatggtatattcataaaatggaatattcagtgataaaaagcaatgaaatatcctgccatgcaaagacatggagaaactataacaaatcttgttaagtgaaagaagaaaaggctctacactgtgtaattccaaccctatgacattctgtaaaaggtaaaactatggagacagtgaaaagataagtgtgtgccaggggttagggtaggggtatggataaataggcagaacacagagaatctttagggcagtgaaactaaatggtggataaatgttatacatttctgaaaacccacagaatgtataacacaaagaattaaccctaatataaactatggacttttgttaacaattatgtattaatcttggctcattaattgtaacaaacatactatattatggtaagtttttaattataggggaacgtataggtggtactgaggcattttgttggaactctctgcatattttgtttaattttctgtaaactttgagattctctgaaaaaaatgaagtccattaatttttaaaactctgctccctagaacatgattttaggagccactaacacctggcttcaaaaacagacatgcagggatggattcattaaaagtgaatgacaaaggcttggaaagttcttcagaggacaataaaatagaactgtagaggccctcttacagctcttataaaacaagcaactgtgtaaattaaatgccaaatggaatccagatgaaaaaaaaaaaacacacacaatttgtcttaacggaatggatatatttgaaagcactgcaatgttttagataaagaaataaataatgtctacttttagaaaaatgaatttctttcactttccccaatatcttaaattctcagttttctaatattatagataatggaattattaatggattatgcagatatttaaggcactgttattttatcagctattcaaggttcaagacacagttctaaagtcatataggctattaatttggttttatgtgtttatttcaaaattcttttaaattagttcaccatgtatttgatctctttagttggtcataaatcccttgtcatctcttccccaaaacaaaactttggatatggcaagctttctaccaatggtaactgaccaacttaaaatctgtccctgaaggaaaaattactatttatctcaaatctgctataattattttatgtcagcctacaattgctgtggttggccaactagaatactttctttttgctggcctcttattatcatgtatgaaagatgtattgattctcaacatccttttattattactttagtatggttttggcaagtggaacttcatcttgtctagttgtttgggagcactagctacagtctttctccatgggtctgaaaaccttcacaacatactggagaaaagacaggccttccattgaacatttactgaggcataaatcatcaccctacaagataatgcgatgttttgaacaactttaattgtttaaattgggaggttcttatgtggggaacaaatttttccttctgcaactgtcatatgttggttttgccatacacaccagaaagtctgtatctctcccacacacatctctcccttccatactaaatatgtattttttctggctaaatattccttgtccttcaaattcaaaatttaatccaattcaaaaattaatgtggttaccatgatcttgacaaaatctacattgtaattaaggtcttttaagatagcccaagaaccaaatgtaatattaattgtattaccactaggatggcgtgagtgatgcagtcacctcaggtgcaaaatctaagggagtgtcaaaaaactcggtaatcaaaataaataatattttaatgcaatatttgcaaaaataacattaatcaaaataatattttagtgcagtatttgaaaaaaataaaaattaatgcaaaaagttcaaatggacaaggatttgggtgtgatgggtgagatgagtcatacaagtaagtacaggggaggctcctgtcttttttggacatttcaatttcttggagttaaaatcctatttggatattagagattcaacccttgaaaggagccagcctaaagacattgttccatttgtactcatttctttttttcaataataattttaatttttagtttagattcagggggtacatgtgcaggtttgttacatgggtatattgcatgatactgagctttggggtatgactgatcccaacacccaggtagtgagcatagtccctagtaggtactttttcagcccttgcacccctccatcattccccccaccagtacctgccagcgtctattgttctcatctttatgcccatgtatacccaatgtttagctccctcttataagtgagaacatgtggtatttggttttcttttcctgtgttaatttgcttgggataacagcctccagctgtatccatgttgctgcaaaggacatacttttattctttttcatggctgtgtagtattccacggtgtatatatattacattttctttatccagtacactattgatgggcacctatgttgatttcatgtcttcgctgttgtgaatatcgctgtgatgaacacataagtgcacatgtctttctggtagaataatttattttcctttgaatatatatccagtaatgggattgctgggatgaatatagttctagttttagttctttgagaaatctccagacaactttccacaatgactgaactaatttacattcccaccaacagagtataaacattctgttttctccatagccttgtcagaatttgttatttattgattttttagtaacagccattctgactggtgtgagatcgtatatcattgtggctttgatttacagttctctgatgatctgtaatgttgagcattttcttgtatgtttgctggctgcttgtatgtctttttttgagaagtgtctgctcatgtcccttgcccactttttaacgggattgtttcttgcttgttgtattgtttaagttccttatagatttttgatattagacctttgtcagatgcatagtttgcaaatattttctgccatcctctaggttgtctgttaattctgttgatagtttcttttgctgtgcagaaactcttcagtttaattaattagttttatttagtttaggtcccacttgtcaattttggtttctcttgcaattgcttttgaggacttagtgatgaattatttaccaaggccattgtccagaatggtatatcctaggttttcttctagggtttttatattttgaggtcttatattaatctttaatcgatcttgagttagtttttgtatatggtacaaggtagcggtccagcttcattcttctgcatgtggctagccagttattccagaatcattattaaataaggaatcctttctccattgcttatttttgttgacttggccaaagatcatatggttatagatgtgcggctttacttttgggctctcaattctgtttcattagtttatgtatctgttttgtgatgtgtataaaatggtcatttctaggaccctttgtgtgcaatgtgtgtgtccagaggtaccagtaaaaaccctgcctcggcttctgtttcagtttgctacaactgacactgtctctacttcttaccaaagctctcttgagttttcctgtgcctttgtctcgagcccacactgcaagtccttagtgctggatctctcttgatgagcaaatacatctgggaaagcccatttctgactccactttaactggcttgaattagaatgctttttgtacttgcacacaaaataccagaaatcttatccaacttgattttcgaagaatggagtttataaagatataggccttttagtccgtattggcttgtcttagttattgaacagaatcaaaacattccatttttctataaaaccaagataattatgaaaaagtagtttttcatatcaactgatctattgaggcttatgttcagcagaacctacttggtaagtttaaactggggatggaaacaggtcaggatactaacaaaatgaaataaactggttttttttgttttgttttgttttgtttgtttgttttttgagatggagtctcagtcaccaggctggagtgcagtggtgcaatctcagctcactgcaacctctgcctcccaggttcaagcgattctcctgactcggcctcccaagtagctgggactacagacgtgcgccaccatgcccagctaatttttgtatttttagtagagacggggtttcaccatgttggccaggatggtcttgatctcttgaccttgtgatacgcccacctcagcctaccaatgtgttgggattacaggcgtgagccaccgcgcacagccaataaactcttctttaacctgccttatgcaataaagtccctgtgccccaaagttgtcttagaaaagacagcctaagtagttactgtgctttggacttcacagcccaagtacatcacaccatcaatatcctctttaaaagccgggagtgaggttttataaaagtatgctttaaacaaatggcagcaggaaattcaaagttgggtaattcatattgctgctataatttgtttgcacctaaaaagaaaaatcgtagaaaatgaagcatcattgcctgcaggtacagacacgtatggtgtctgagatcattgttattctcttcctctcatttttctcccatatcctcttaatggaataattacattattgtaatttacttgtatataattcaggcaagctaagcacaaccaataatatgtttcttcagaggaaaaaaacccaaacataataattaaagaataaattagttactgtaagtagcaagtattccaggtttggggagaaagtgtaggagatgatcccctcagaaatggacaccagtggatggtaacatgtgtgggaacaagagtgattccatcttggatgctaatctgccatgttggctcctgattaaccctgagtctgggaatgcctccaaggtgtctagttgatgatttactctctatgtagaaacacttatttactctgagttacacctttcctccacaacaacccttgatcttgttgcatacattacccgtagctgtaacacccatagcattctctcggccacccactcattccttccagagcaaatatacttttcctccaggatatataaaccctgggtctggaaggttgtagtgcgaaggcctacctttcttgtggccacccaagaccacgcttctgtctgtaagttccccaataaatcacccttttccaacacactggatttttctgctctgttctttggtttcttggctccttctgtatttggtggacacttcgcatatatgaccctttcacggaacaatgtgaaacttaaacatgcagcattttgggacgatctactttaagagatgttctgtaaatgatctgctgtgtaggccatgacatttcctcaggctcaccactgaaacatcaacctactataaaatgataaaacatgtgctttaaatgtgagcactctaacatatttatgaaagatgacacaacagatgggcagaaagaaacactgagaatgggaattttattttctttataatttttttttttttttttttttttagacggagtctcactctgtcatccaggctagagtgcagtagcacgatcttggctgactgcaacctccatttctcaggttcaagcgattctcctgcctcagcctcccaggtaagctgggattacaggcacgccctaccacaccctggctaatttttgtatttttagtagagatggggtttcgtcatgttggccaggctggtctcaaactcttgatctcaggtgatctgcccgcctcagcctcccaaagtgctgggattataggcgtgaaccactgtgcccggctgggaatttgcttttcaacagggaaaagaggcagtgtatctgccaggcaataatgatgacaagcacaaaacactaatttcaatgtattgagtatgtgagaggaccaatactagtttccttagctgtattaatttgaattattttaacaactttaggaagtcaatatgatttctgtttgaaaagtgagcaaacttaggctcagagatattgcacgcctaaagtcacacagttggtatgtggttatgacagtatttatgttcaggtctgtctgcctccaatgcctgggtttttctctatgagctccctcttagctgttccagtgttcctccactagaatttcatattctttagtgagacaatctccaggcattatcctagcttgaataaaatgctccagaaagttctccaactcaaatctacaaatcagtagtcgttttgtaaaataacttctttctccaaggacctcagttttgaggaatgtgtgccctggatgaagaaactggcattctcactactggaaagaaataattttgtctccgtattaatttttcggtattctggtttttagatttttttttcatgagttatgttagtttcgactcttttgactagagcctgaccattcttggatgatcgactaaattcaagtttctgaaatgacacacatgagagatagctttattgattttctatgaattttcttattttttcttcttataaaaatgtctctccaggagcaacaccaaagaaagccaagctgctgcaaagcttctcactgcctttgtatattatgccagctcctctacctcaaacgcttgccctgccttctcatctgaaaaatctttcctcttaagatccagctcaaatggtaccagttctctcgcaaaatcattctggaagaccccagggaaagtcaatttctcattcttttaaacattcacataattttgcatatatcactctcctattcacttgacactctacagtaactccttctgtataatcctattttcccatctagcctgtgagctacccaatggtgtcaatgaactcagtcccctttgcgaacctagcatcttctactgcactggcataggaagaaaaatactcaataaacacttgcagaaatgacatttaaaaaccatgcaatcttgtctttgaaaactgtactgttcaggaagatctaagaagatgaatacttactaggggctctttttctccttgaagagcttgagtgaaataatggctgttgaaccaagtttgttctaagttcactgaacttgatttattagcattgaattttcttttttagcttttttttttttttttttgcttgtaattggcctcttcatgtttaacacaaccctccacctataaaaatcataggatacttcacagaacagtgagaaaagcggacccttgggacgtcaagggacttactaaaaagcacacagctaagtgggagagttgaactagaactctggttctatgggtctattttttattctttctagtaggccaggttgctatgacaaaacaataacccctttaagcttatttacagctctttaacctaatcagaaggctttctttaatagttgcagagggcaccataccacagagaaagttgtcacgaggtctggtgactttccaaacaaagccgcttatcaattcaatgttaaaaatattggtcccatcctgagaactgtggtttccttttcttaatgaaaaaagcaataaaacgcaagtacacatccatctacacatacaggctgtcaataataaaataatgagagatggcactgaccataatctgtgttttccggctcccaacaatttgatggccaaaaatagggggtctgcggaatgaaaagaagtggaacccagattagacaaataaaaaattagtggagtttctggccagtgaattacatttatcttccacaattctctatattagtttgctatatgttttataatacagaacatgttccaagagagacattgaaaactctttgtctacatgtactttgctgaccaattgctcagcttctaaacatgtgtagtaccagcaagcaggtatttagaatgtcatccctttgctgtaattttacaccaactgacataaaggcaaaaaggtctgattgtatattcaagcaaaaagtattcatccacagagaggactgaaagagtatgttcggcaagactcaggatgaaatatatttaaatataacaaattgttttctatgaatcatgtatttcaacactgcttttggtagctccaaaaagctcaaccaaccgatagactctttctctgagatctgacaatgatttgcctggctccattagtcatataattcagttctcagcattgtccaatgagattaaagcaactttttactctcacttttaaagacatttcctaaattcctcttgtaactaatttctaccatttagtcgtgcaacagggtgactcgagtcaatagtaacttaattatacatttaaaaataactaagagtgtaactggattgtttgtaacacaaagaataaatgcttgagggaatggagatcccattctccatgatgtgatgactccacattgcatccttgtatccaaacacctcatgtattccatacgtataaacacctattatgtacccacaaaaattaaaattataaaatttaaattaaaaaaacctacaaaaaataaataaaaatagaaacatttccttacaaagacacttgtttctctaaagttttaaactgcacaaatcagagattttttttaaaggaatagtgtcttaattgagtgatacaatctgcaataggcagaatccagattctgtagaatctagaaactgactgactaaactacaaagaaaatgtctgaccgagagaaactttattattatcattaacatttatattttctaaaaggactttcctagccctgctagctgaacatgcttggctcctgaccacgaagaaacctgatgatcacctgtctccttatcaacccctagtccctggaatgatgaggcctgcaggactcactgtaacagtgatggcaaatatcagtactgtgggcttaattctatctgttagctaattacactaactaccatgtgcaataagcatatttggagtcatctctgattatctgatcattttcccctctagaagagagactctaaagaagggaaaatgggtagatagggagaactgtttgaatctctacagaaaagtctttccaaactgtctcagaggcccccccgactaccatcacccagggatttcaacttaccctccgttctttcttgggaattacagtagtaaaataaagaaggctactaacagtagttttgtgaacatgagaacaaaatcatcgtaggaattctgaagaaagaaaaaaagactaaactgctagacaaaagaggatagtaagactttatgtgggtcacccttatcaccccaatctcacttgactccataggagatgaagctttgagaattcgatttcttaaaaataaaattgaatcaggattctaggatagccctagggggacaaagtagttaaaactttgctttcatgtagggtgtcactttttttttttttgagacagggtctcactctgttgcccaggctggagtgcagtggtgcggtctcagctcgctgcaagctccgcctcccgggttcacgccattctcctgcctcagcctcccaagtagctgggactacaggtgcccgccaccacgcccagctgagtttttgtatttttagtagagacggggtttcaccgtgttagccaggatggtctcgatctcctgacctcgtgatccgcctgcctcggcctcccaaagtgctgggattacaggtgtgagccactgtgcccggcctaaaaacgattttctgatatgctatttcttaggttttataagagatatatttctactttggtatctttctttttttttttttttttttttttttgagacagagtctcgctctgtcgcccaggctggactgcagtggcgcgatctcggctcactgcaagctccgcctcccgggttcacgccattctcctgcctcagcctcccgagtagctgggactacaggcgcccgcaccacgcccggctaattttttgtattttcagtagagacggggtttcaccgtgttagccaggatggtctccatctcctgacctcgtgatctgcccccctcggccccacaaagtgctgggattacaggtgtgagccaccgcgcccggccggtgttactttctgagatgcttcttacggagtgcattgttccctctgggtagtttctatattttggggagtatatatgtgtatgtataggtgtgtgtgcaggcatatctatttatctaaccttaaaatacctattctactcagacaagacatatacttttttcccacaaaagcacaaaaaatattctcaactgcattcttatatttttcttcattctccatcatttactttagtgagaatttaatgactgtaaaattaaagcataaagtaattttttcttgtgatattatgtggaaatgccactaaaccaatgttcttcactaatatggaagattttttctaagaagtagtgttttgatctgtagtaaacgataatataggagaacaacaaactcttacagttttttttggaatttaaatacatactttcatagttctaccatacattaggacattttaatgcatgagtttcttgatttttcaatattggcttccttagctaggatgaaactcatccaaaactgttcaactgttgttcaataactgttggagcatatactaatgtattgaaagtcatgaaagagagctaaagaattacatcagatctcattttcagttagctaagagaggatgattagacaattgtgactttacggtaaatttaaaaaatcacatgattaagacatgtactacaaatttgagacaaatatataaactgtcatgccaatgaaataaagatttctgtttatctcaaattaatgctttgaagactctttagatttttttattattattattttgagatggagtctcgctctgtcacccaggctggagtgcagtggcaccatcttggctcactgcaaccttcgcctcctgggttcaagcaattctcctgcctcagcctcccaagtagctgggactacaggcacgcaccatcacatccagctaatttttgtatttttagtagagatgacgtttcaccatgttggccaggatggtctcaatctcgacctcatgatctgcccacctctgcctctcaaagtgctgggatcacaggcgtgagccactgcgcccagcctagattcttaatgatggttagactcccaatcattcactggaggatttgtaaacacggcatcccaacttttctactttaatttatgattttaaaatatccttccaaggagttgaatttcacttcggtgtaataaagaactttcgctgcttggaaccaacgtaaaaacagaagtgaagaccttgaataataatttgttttctattattggaactcttcaaatatggactggttaatgacttggtagacattatagtagaaattcagttacctctgagttttctggtgttttttaaaatcttggtttcagaactctaatattattagatttacaaatgtgtttgttatatttagatactatttcaaatatggatgcatcattaaaatatgtaacatttactatttagcactaatgtaattttaatgtgtatatgtatagatagtttattttatatctgcctatctatctcagcacactgaacttgacaactctctgtctatccctagtagttacataattcatatgtcatttgtacccattcccttgctttgttctaaagctcttttaaaaattctctccttttctcctgtgtgtatggtgatcccttccttcacatggcttttttttttttttttttttttttttttttgagactgagtctcgctctgtcgcccaggctggagtgcagtggcacaatctcggctcactgcaacctccatctcccaggttcaagctattctcctgcctcagcctaccaagtagctggaattacaggcacatgccacaacacccagctaattttttttgtttgttttttttttagtagagatgaggtttcaccatgttggccaggctggtctcaaactcctaacctcaagtgatagcccgccctggcctcccaaagtgctgggactacaggcatgagccactgtgcccggcctcggtgcccttttagacccatgagcatgactaagacatgtaaaccttgtctgtctactacattttctgggaatagagatttctttaaaaaaatcaggaagcattagtcacataaaaacaatttatttgctgatcaccaataattcctagttattaaaaatttaatcttggggccagaagttactttaataatatgctattttaagctaccattagtgtaagttttgctgtataaagaataaagctccattaatgtaaagcttttttaagttacgtaatttaactaagtgcttgaatacttaggtcagtatcacagtttcaggatacagctttatttcctcctagctcttaagtccaaaactgtcctacgattatttgccttggaagaaatgagtccaaggaaggggcagtgagactgttctatgaggacaataatctttaaaatgattttttaaagcaaatgattaaagtgatttttaaagcatatttcctctttgttctcagttttcccaaacaaattttaggtactctgattactattcagtcatttatgtagacatagagcatttaataatacttagaacaagtgagaagaaggctccaaagtctgaaagttggactgtggggagaaccctccagcaaatacctcttggaaatggattagagtttgacatccagcattttatgtgccttaattttacaggctagaatctgctaatcagttattaatgagccataatgtctactgaaatgtagaatatactttaggtaaatcaatgtgaactcaagtgtcaaatatacttacaatgactgaaatcagagtccacaatcattgccagaaagaataatagcatctgtgtcatttgcaaatgacctagaatgactcttatcagtttgcaagttatctgaggtgtcctgttgcagttgagtgcacacacacaatatatcatcatgtcagtctttacagatttgtagaagagcctaggatgctgagagtttattaattagctgaatcctatctggagtttcaagcattcctgttaaaatttacttgggctgaagatggtctggatcacaggcaagggtcagacagaggaagactctccggtccttccgaatgccattaagtcactttatgaatttcccttaagcttttcatataaaatagaaattcaatcatcacacaatttagctttcacacatcatcttgactaagcatactttatctttctctgtgtttattgctttttatgtctttagtttaatgttaatcagtttctaactagcctaagtcaaagtaaaataagtcatagtttttaaaagttctgttcaaaagaaacctaactaacaaacgaaatgcgggcttctagtttactgttaaagaacatttctaataaacttacttgaaaccggtaaaaggtgccatcatccttgagtgtgaggacatgatctgagattggaaagaagtagccgtgggcagccattaatgttcccaaatggagcgcctccactgttttatgaaaacaaacaaagaacataaaaaagccttttaaatgtattcttttataggaatgtaacgtttttgtgtggttccttttgtcagatacagtaagttcctcttgaaagatttaatttctgacttccttgttctttgctctcgagataaacttccttgtcccttctcctaagctacctgctctgtaaacaacttctcctaccagtcccagtctgtaactcacatctcttccttatttggaaacagtcctcctttactcctggctacccattctgtaaactgcccctcccactgaaacaggtcttccagccaaaactacacttcctgcctttgccgtgccctgacatgcccaaacatgccttgtaccgaaacggacagcctctcccttcccacctaattagccatattcaattttaaacagtagccaatcgggtcagtttagattgtgtggtacgactccagccaatggggacaggacacagaagcagggactaatagcgttagggataaaaaccccttccctcctttgttcggtgtgctctcgcagtggccagaagtgcgagtggcacccttctgcagaagtaaatttgccttgctgagaaatcctttgtttgagtgctcgttttccttgcgactcccagctcttgtttctaacactttagagtacattcttggcattctgaaaacctggctttgtgctttttcttcttttttcagctctttctcacaagacactaagatggttctagttcctggtagcaactgccatgaccaacctcatccaatgacaacaagtccatgagaagataaagttaagaaacattaaaatgggaaggctcttctcaatctgtagagtatgtctccctcattttatagatgtgtgttggcccatgtgataatgttctctcacaggcagttgcatttggcatttatagcactttaaacttttaaaagttttcacttgcatcacctcattctcaatatcatagcaatctagtaccatcagtaatgtttctaatgatatggaccattattttgtgatgctatgagggaatgttaaggcatcaaggaccatgtatgctgcactattgaatctacagactggtgattgtaaagattgttctagcttttactattctatacagtgttctaaatatggagtaggaagagatttattggacaatgtaaacatatagtctgaaactaaggctgtaatactcatactgtttatagctgccaacaatttcttccaacaaaagggttagtaaaatttggtcaatagttattactgcgtttgtgcagagatgacataaagttttctaacttaaaggctagaaaatatgaaattatgcaaaatagttttctaccccaacaaaaaaaatatatgtacagttgtcccttggtatcctcaggggattggtttgaggacctgcacagataccaaacatcaaggatgctcaagttccccactttgccctcccacatctgtggatttttgatcatgggtggttgaatccacagatgtggaagtcataaatagagagggcctactgtatgtagaaaataccagaaaagttagatttatttatctgtttatgtatctttatgtataattcatttataaatttatttctgtttcttagtcaagaagctaggattcttacagcagttctaggacaacatggatctatctatatctccagccatcaaccatggggagcttttacacctcagttaagaactgagtaactaagtagctagctatggtacagcaaagcataagaatcccatccttttaccccttacacctacataaataaacaatttgttgttaaatttttatctgttttggggtactatgatgccccttgaaattgttatctagcattttgcaaacatttcaattgataacttctacctctgatctctccctgcattgttcttgccgataataaagaacaactgccaattattcttcattctttgccctggctttggaagactgttactaactgctccagccatcatctccaaactcgcagtcaagtctctctgtatagaatgttgttttttgtacagaggagcatttttttttcatcaattttgtgcgtgtgtgtgtgtgtgtgtgtgtgtgtatttccatcatttcaacatcctttcagttcaaagtcaaggccttctcaaagcatgcattgctcatagcaacatgcctacctatccttgttaaaactttagtgccagggtgtcattgtggaaagaacaagaactttggagacacccactgtcttctgttactttcattctctgtgcctcccccatctattaataaaggtcataaacctacctggcaggattgacgtgagaatgacataagcacacttgtaatgaaattggaatcatgcttccagcctagtaggtactatgtatatggtagctactgtgcttcattatttacacacaaaataatttttacttttctacaaaccactttcagagaatctacttccatacatttgccttctgctaggttgagtgaatatttccaacacaaaaaaaacataaaactttgaagtgatagatatgttaattattctgatttgatcattgcacatttcatgtattgaaatattactctgtaccctataaatatctaacaaaagttttaaaaagctaggctgagtgaggaatcctgacagtcctaagcagccacgttcatcaacatcatcttattctctttttttttgactgtctgtaaaattaaaatggtaagaggatctagaaagatagttggcccataacaaatgagcaggtggttatagtcctggttaaattctgaatccctaagtacccctgtggacgagtgaagaatatgccatcccaaaataccccagattgtttcaagttgaaaacactggatgaattgtagtttcagaaagggctagctggcctatctcttcctatatgcagcaagccataaagattcctctgggaggggtatcttgcttttgccagggcaagaaaatagctcttatcaccagagactgggagttgggggctgcaatgaacctgaataaagggctggatgcggtggctcatgcctgtaatcccagcacttcgggaggccaagacggatggatcaattgaggccaggagttcaagaccaccatggccaacctggtgaaccccgtctctactaaaaaaaataaaaaataaaaaacttagctgggcatggtggcaggcatctgtaatcccagctacttgggaggctgaggcatgagaaccacctgaattcgggaggtggaggttgtagttagcagagatcacgccactgcactccagcctgggcgacagaacaacactctatctcaaaaaattaaattaaattaaattaagaaataaacttaatcaagtaacccctactttccactagttttatgcccccaatatattccctagtgattctgctagaaaatttactgccttcagccagattttctttgttctgtcatttttttcttaaatttattattgtttgtctaaaaagtatagaagtgtcttgctttggccatttcttcagacttcacactcttgtgaagatccccatgtacatgtaaaactaataaaatgtgtatgattttctctattaatctgcctggtatccacctggtctccagatccacagaagagcttaggggggttgcagatgatctctgacttccttacacctgttagggaatatagggtggggcaacatgtaacatcctttgtaggtggcccatctgtcttcgtatagccatctttattattttagtcccagcagtctgtggcctgggaagatagtgttagcacactttcccggaagaaaaattaagttacggcacataaggaaatctgcggagtatagatacaagaagggaaaactgagatgcccaggaagatagacagtaagaggagcttctgagttctaagcataggaaagagtgtgactaaaaccaagccaaggaacaacaaaaagcaattgggtgttaaagtgttgatgaggattagaaaaatagagtgaaagtaaatatagagatgctacaaaaaagaaaaacagaagtgagtgatcataagactattcttgactcctgcatctcattaactactaatttacaagttatatacttatagagtgcaaagtgtatgttggcaggttcttcttcatgtaatactaccataattagtcattaataaatgcttgcaaatgagtatgagtgaattagtaaaattctccttccttttttgaggtacaatattttcatttgatttgatgatatgcattctcattttacttctcttctgagtgatacttatgttccataattttacaattaaggaaaatttgttttgatacttttgcatcatgtcatgaatttagtagaaatatactggtggtgatacaggtaagacctagatttaatttctatgtgagtcacacacatttcatatgtcaaggtgaaatcaaaccttttgacttaatagttaagaggactgatcttctcacaatgcttacaaatggttttaagatttttggtcaaatagtaatctagaggtactgaaataataatagatattttgtgttcattacaggatctccagaaaatatagctccagagcaggataaatgcctagatgaaaaatcagaaagttggggtgaattttttgcttcatttaggatgacaagtttagcactcagcatatccatggcaaaagtagcaagtgaatcaatatttgctaaatcaatgaacaaggacatttatgagtaaatgacacaccaagaatattaaaaacctaacactgcatagaaaaacaccaggctaattattgtgtgttataagctgttgaggtggggctattgtagctattttgttgtgagaaaatataatagtgatattaacaagataaatgccagtaagaatggacttggggcagtattctcaagacagacttgtttattgttagggacaaacatggtgccacagttccctgtggtcccactgctccgaaatcttagcaccatcttaatctaataagaatccataagaccgctgacaatcttggaacaaagtgttgaaagagtttactgagtaatctgtcaagatcactctcccaataacggcacaccagatggcccagcagcatcacgcttcacggcaaaataatcgctaattaatcttctcgtacatgtgttattctcttcacccacacagctaaagttcaacaataaacctactaaaaaattccagcttatttttttgtttggatattcaagccatgagcaagctgagaaacaaaaatcaatctccaaacacctctgattaagtgaacagcctagaacagctttgttaagcctgataccaacataggatgatttcaccccaaactctaaaggaatggtattatcaacatcctcggatagcgaagagaattctccacagcataatttgcttttgaccacaacgatttcaaaaagttaacaggatgaaaaccacagtataaaagaggcttgtggaactccaggggtgcaatcggttagctcacggtgcttataaaagaggcttgagtacttgagtgtaaagtactctatatttacaatgtaattttaaaactcagtaatatttttcttacccagaggctcaacttcttgcagcctcctcttcttttaaatacagctcataattttgcaacgattaataaaatgcctctgagtcaagaaagtaatttaaaaacttcactgaatcctgtatttttatcactatcatgttatttactcttatttatgtgcatgtattaacatttttttcatttccaacacagtataagtatcagtagtgtgtggggagaaatattttaaaagaaaatctaaaaagaaaaaagatggcagctgattatattaaggaaacagagatgctaaaatgaagacaaaggtaagttacttaatgataaaataacaggtattcatcaggacaattctgagccataaaaagaagatatgttagacttgttactttctgtttaagaagacatggaagtggtcattttagaaatccttcaaaatattatgctttattttttagaactggcatttggaaaggtaagattattcatgtagaaaaatctcatatgcggaacattttattctccaacaaaaccaagtaaaaatggactattaccatatttagaaatttctgaagtaagtttattttctcaacagtaggagttagtaaaagaagtacctcagctttcatctttttaaaaaaaacatcatttgcatgtaagaaaaatcaagtgccgctttctcaacagcaatcataattcgggatagagaagtgaataataaggtgacatagaatagataagctaaaagagattctatttgggagaaataaaaacagaatcataatttatatcaacattgaggaatgcaataagaaattaatataagtaaacgctatttccaaaaaaggagcagagtacaaaggctatgccagtcccctgcctaggttcacatcccgggtccctcatttgctggctgtgtgacctgagcaagagacttggattctctgggccttggtgccctcatctgtaatcatctgtaagaagttgacaaaataataatgccaaagattagcagtaaggatccattgagataatatgcacaatgcacttaaaacacagtctaccacacagacatgctcctgagatgagagttattatcagttgatacttatgaagtgtcacattcaggagcacttaatctagtttaaggggcgatgggaaacattagtagctagtgttgctctgggtttcccagtcatgttaaacacttccaattcaactctattttaaacgccccaggtgatcaaaccagagtgttttgtgggctgaaatatgcctatgtttttccctacagcaaagaacactaacaaaatcccaaaaagaaattagggacaaacttattatatatcacagggatagccacagatttccaaaggcggcatgctccacacgctaggtttacaaaaccatactgtgaataccagatgccaatgagagacctgcctgctttagaggaggactgatgtgaggacaccctgaacctgacagtagaagaataacagggacagagagagcacggggacagcaatcagaatgggagatgaattcttagggaagcataatatttgcctaggactaaaaaaagaaaatcgacattaaaataataaagcaattggcagtgagagcaacagataatcataagtcaacgatcttttttacacacacagagtagaccagtctagatgtctaatggcagttatgacatcttaggcattctgcatagatgaaaaatcatgctgaaatttgaaaaaatgatccatgtaatactggtgtgaataactggtttcagatctacattatacagcctatatgatattagcatgttcattccccagatttagataggtagttccatcagccaatcctttaacaagattctgttatattatatgtgtgtgtgtgtgtgtgtgtgtatatatatatatatatatatatatatatatatatatatatatatatatatgttaggtgcatagaatagtattcagatgagataaaaatcatgcttacttcatctaagtacagtgtgaggaaaccatcacaatggcaagggccagggcagtaataaattacagtggaaaacaacattccatctaaaattcagtatacattctgcaaaatttccattagttaatctggctgaatgagctggaagaaagtagggcactgaattaactttttagtaggcagaggagtttctacagcatgtatttcttcaaatcagagagagcacacactgccaaacaagcacatgtggaaatcatgggaaaaaaaggctcaactgcaagtcatggggcttaaattctaatcctagtgcctgtaactgcatgtcaggagtaagtcacttcctttcttttgttttgagatggagtctcactttgtcaccagtctggagtgcagtggcgcgatcttcgctcactgcaacctccgccttccaggttcaagcgattctcctgcctccgcctctcaagtagctgggactacaggcatgcgccaccacgcccggctaatttttgtattttagtagagacagggtttcaccatgttgggcaggatggtctctatctcttgacctcgtgatctgcctgcctcggccttcccaagcattgggattacaggcgtgtgccacgcatccagccaagtcacttcctttcttagagctggcatctgtaaatgcagcggggatcactaaagactttttagttctgagtccatgacaagatgtgcagtcaaaacactagctagaagttgtggcagagcagccgccatccttatttttgcctccttgtgtcaaagggaaatggatttttctttatttctcagacattcttgccattgcccatgtcccaatactctaacacgaaagagaaaaatagcccaatacgaaatataaaagctgattttaatttcagttgcttataactcaatcctgatgattctcaagggctgctatagtatagagtttttgtacacagagcaaatgaatgcttattccaaataggaactggttttatgagtgtgttctatttacacattttcaaaaactagttgtaaaaacgcacacatgtcttgggattagccaataacacatcccatgtgccaaaatatcctgaatgcattttgtttgaaaatcaaatatcactcctaaggaataagcaatatagtcttctcataatacctgttaatggtatctcttttaaaaatcactattccttaatatttgaaccataatgaatgataagtctaatttcaaagccacaggcttggtcactgaaacagtcacagtttttatgaaatttcaaaacaaaatcagtggaatgcacttttatctgtattttgcagaaacaaatgcttgaattgagaaaagtgtgtaggacgtcaggactgatgtttgcaacttttgaataatctttacagcaaagtatcattttaaaaatcctagtttataaaagcacatgtatttatcaatttttatttttaaaatctctgtgtgtatatgttggtgtatgagttttagtaactaaaataatctgaaaataagaattttagattttagaatacctaaaatctaatacacaagctttccatgaacctactggatagagatcatctttctcaaaattagtttggaaactagatatgggtaaatttgttaaataagatgtattaaaacattttttctgtttgctgttttaaaaccagcacagtctttcataaacaatttgattgtaattttaaataccacaattaaaattataactactgcctaacaataacaatgaggcaggttcagaatccataatgagtaaattcagatgagttatttaaagtattaacaactcccctcaaaaatccccccctcttttcttcaccattctgcttgctaatttcactattttttgtaattagccagaatttaaacatcagatgtttttaaagaattaaaatcaggctgggcatggtggctcacacctgtaatcccagcattttgggaggccaaactgagaggattgcttgagactaggagttcgagaccagcctggacatcatagtgagactccatctctacaaaaagtttcttaaaaaattagcagggcatggtggtgcacacctgtggtcccaggtacttgggaggctgaggtgggagaattgcttgagcccaggaatttgaggttgccattagccatgatcatgccactgcactgggtgacagagtaagaccccctctttaaaaaacaaaaattaaaaaagaattaaaatcaattagcctccaagaaaatatggtttcataaggttcttttaataaagtacatagtgagacagctttatttccagaattcaaataaattctaggggaggtgggggactgggacaggctggtcaatgggtacaaaattacacttaggcaggaagaataagttttggtgctctattacacagtagggtgactatagcaaataacaatgtagtgtatatttcaggatagctagaagaggagattttgaatgccgttaccgcaaagacatgataaatgtttaaagtgatggatacggtaattgccctgatttgttcattatattatatatacatgcattgaaacatcacatcataccttataaatatatacaactataaggtgccaattataaataggaaaataaattctagatgctgtaggtgatattaacaagaagaaatgtctggagcctcagtggatcagtaatcttggtggacaacacacacatgccccctggtgggaagagtactgcattatatggggcaatggttatgaggctggcctttgagccagactgccctggccccgttgcatcttagcagttctttagtcttcaaaattcaaatttttaccattttcattatgtaataagctttcctataaatgtgatcatcattcttagaacacgtatcttcagactggcttctctcctaaattcctgtatggtattctgaacagcctttgtgacatctccacgtgaatattgaataaacatctcaaattcatcatgtcaaaattgaattgttggctttcatctgaaacccactcttctcgcagttcttctcacctgagttaatatcagtgactttcattccactgctcggaccaaaaagcttggatcgtctgatgtctttctcccattcaccgactccagtccagaagcaccttctgatgatcctgttttgctgtatgttcttagaatctgccctcttatcagccacccacatccaccacctccaccaccccagtccaacctcatatcatcctgtggctgagtcactgcaacaacattcaaactaatttcattcacactttgccctttgctatgatgattatcttaaaacatatattagatcaagtcgctcctgtgcaagccctcaacaatttcccctatttctcaggatcgaaataaaattccttgtcataggctttacaagatcttatatgatctggccaccccagttacttctctgtcttcctttcctatttccttgcccatctttacatatcctcctctagttcacagacctccttgttgctcctcaaacataccaagcatgcgcaggccttaggctttgctaggctctctgcctggaatgctcagaacccttcctccagagagcagaacaccccacttccttccttcagttggattctagccaaagccactacatcagagacaccagccctgactacactggtgtagaagaccgcgtatcttttagttggctttcataaaaaccatttttatttagtactcatcaccacttaccatataacatatttacctatttttttattgattattatcttgtctagtgaatattttaagctctaggtaagtatggacatttttgtctgtttgcttggttggttttagtggtttgtttgcttgatctactctctgacagtgacttaatttctgagatattgcaaccaactaaaaaatatgagagcggaaatggataaaaggatcttacattagttcatagcacaaattcttagaaataaaataggggagccaaaagacgcacatattttttaagtgttgctattttatttatttatttatttttttgagacggagtctgtgttgcccaggctggagtgcattggcgtgatctgggctcattgcaaccacccctccctggttcaagtgattctctggcctcagcctcctgagtagctaggattacaggcacgtgccaccaagcctggctaatttttataattttagtagagactgggtttcaccatgttggccaggctggtctcaaactcctgacctcaggtgatccgcctgcctcagtctcccaaagtgctgggattacaggcattagccaccatgcccaggctatgtatgtctatgttttttaaacgtaatattgttccatctccagatggcatctggagatggcattattagcaataatacatatatagtataacatacatatatattatatatatataatttaaattctcaccaaaagggtataaatgtgttggtatccctgtaaagtagttaaccacttggaattattatttattttctcgttcttcatttgctgggaagaaatggcattttgctttaatttgacttaactggagttatattgaattttagctaaaatgcacagtcttttaatacacagtatgagtgaaagaaaagacatttcaagttgacagggaaggtttcacaaaagggtaggttagactaggaatggaaggattttagactgttggtcaagagggaggtccttcaatttctccccagttctcctaaaaatgctctcttttcttattttctcacctttcaattttgatttgtttcctaggcttatcttatgtaattaattaataaaaatgcattccctttttatttttcaaattctttgctccattatttactcataccaggttttattaatttaccctattagacttcatttcttcagccattcacctgtcatccatccacccatctgctatccactcatccaccatccattcacccatctgctgtccatctaacagataattattcactgtctgcttggttttaggtgcttaactacaagccacagatataaaagtgaaggtgacactctccctctctctaccctcaagagactcacagtgacatggagtatcctgtgctttaaaaagccaaggatgggccgggtgtggtggctcacgcctgtaatcccagcattttgggaggccaaggtgggcagatcacccgaggtcaggagtttgagatgagcctggccaacatggtgaaaccccatctgtactaaaaatacaaaaattagcagggcgtggtggtgcatgcctgtagtaccagctgctcgggaggctggggcaggagaatggcttgaacccaggagacggaggttgcagtgagccaagatagggccactgcactccagactgggtgacagaacaagactctgactcaaaaaaaaaaaaaaaaaaaagccaacgatgacttctggttttaactgagacatttaaagagcttagaagctgtcactctcatcctttcgacaaaagaaaaccaaacaagctgaaaatcaactatttttcctggaccattcagagaagtaaagttgtaggacaaacctccattccaaaatctgcatagacaggctcatccagagacatgaccaagatctacttacttggagcagaagcttttggatccataaactgacagaaacatgaaaatagctcttctgacaaagaacttgagactcagtgtgaactagcttgacaataaggaactcgaggggctcatagtgttggtggggaatggagcacatgccttcatgagctacacttccagaaatcccaccagattctcatggtgaagatccaagaaagatccctcatggctctggcagaagagggaaaagtaatcattgcgaaaaatgcccagagccctctctataacaaaggcctctaccccaaaggaaagacattgtcagacattattctcaccagggaaagggcatttctccaactacagtcccctctagactttgtctctcaccgaagggaggaataaaagcaaacaacattaacaggggcagagcttctacaaaatagtttgggaaagctacagctgggaaaggaagatagtggtgggagacaggggatctatacttctggagaacacttgcaaaggtcacagctccaagggacagactctgaaatgctgagatttcattgaaatattatataattctctcattccctaacaactatccaccatacctataggctatggtataatatcagattacagctgaaagagctgttaagacacaaacattctctgaggtgaaatacttagaggagctcaaagtcacagaagaataaaaataaaagcactagaggaatttgaagcttctgtcatttataaccacagcaaacattaagcacggtccaagtactaaaccataaattagcacactaaaggcctgagttcccattacctaatacaagatgtgcagctttctttcctttctctctctcttttttttttttgagatgggagtttcactttgttgtccagctggagtgtagtagtgtgatcatggctcattgcagcctcgacctcccaggctcaagcaatcctcccaactcagccttccaagtagctgagaccacaggcacgtgcaaccacaccgggctaattttttttatttgcggagatggggtctcaccacattgcccagtctggtcttgaactcctgggcttaagctatctgcctgccttggcctaccaaagtgctgggattataggcatgagccaccctacccagccatgttcagctttgaatgtaaaattacaaggcaggcaaaaaagtaagaaaaacacagtgtgaagaggcaaaacaacaatgagaaccaaattcgaatatgacacagaaattggaattatcagacaggaagtttaaattgtaattaatatgttagggactctaatagaaaaagtgcaaaacatggaagagtagatgaataatgtaagcagaaagattctaagaaagatattcgaagaaagaatcaaaatgaaatgttagaaataatactaaaaaagaaataaagaatatcttgctgggctcattagcaggctacacaactctaaggaaagaatcagtgagcttgaagattaaccaacagaaacctcaaaaactgaaattcgaagaaaaaaataacaaggaaaacaaaaagaacaacaataacaaaagcatccaaaaactgtgggacaatatctaaaagtgtagcataacataattggaataccaggaggagagcaaagacagtgcagcagaagaaatattgaaatgataatggctgaagactctccaaaattaataacaaatgccacactacactcagagagaaagaaaagtaaataacaaaaaaatctaaatctacacatatcttattctaactgcagaaaatcaaagaaaataatcttgaaaaaagcgagaaaaatatccttacctatagagaaacaaaaatatgaatgacagtgcgcttctcatcagaaactatgtgggcaaaaaagagaatacagtgaaatatgtaaagtgttgaaggaagaaaacccactaacctagaattttacatcaagtgaaattacccttcaaaagtagaggagaaataaatattttctcagacaaacaactgaaagaatacattactagtgggcttgccttgccagaaaggttacaaagaagttcttcacagagaacaaataataatatagaccagaaacttctacatacataaagaaagaaagaacatcagggaagaaataaaggtaaaacaaaatctcttatttttcttattcttagtttatctaaaatataactatttgtttaaaataatagtaacagtattaggtgattataaaatatggataagtgaaatgaacaacagcagtgtcgtaaaggaagaaagggatgaattgggaatattctgttacaaggtaccttcatggtatatgaaacagtatagtgtaatttgaacatggagttagattaattaaaatgtatatcgtaaactctagaacagctgctaaaaactttaacaaataagtacaattgatatgctaagagaagagacaaaatggaattatttaaactgctcaattaaaaccagagttggctgaaaaagaaggggggaaaagacacaaatgaacaaatgcaatggagaaaatgcatgttttgtccaaatgcattgcaatacaatgaacaaaatacatacaaatatgtaagaagaatccacatatatcaataatcaccttaaatataatggtctaaatacaccaactaaaaagcagagattatctaagtggattacaaggaaaaagacctgactatacatgtatataataaactaattttaaatataaagactcatatatgttaaaaggggggaaaagagataccatgttcacactaatcaaaatcttttgaaatagtatctaatacagaagcaatattaagtttaggcaaggcagacttcataacaagcaagtttatcagggataatggaaagcattatctaaagagatcaattcttcaacaacaataaattgattatgaagatcacttttctattacaatcctaaatgtgtaagcacttaacaacagaatgttaaaatacataaggcaaaactagagagaactgaaaggaaaaataaactcattattacagttacaaacttcaacaccactttttcattaattgacagaccaaataagcagcagaaaatcaagcagtcagaatatagttgacctgaaaagtactatcaatatataaattgatagtatatcaatgatataaattgacatttatataatgttctatccaacaacagcagagtaaattattctaaagcatacatgaaatattcatcaagatcaaacacatcttgtgtcataaaatagatcttaaatctaaaagaacagaaatcatacaaagtatattctcagatgcaaaggaattaaactagaaatcaataaaagaaaggtagttggaaagtctccaactatttggaaattaaacaacataatctttagtaacccataggtcaaagaaaatgtctaaagagaaactgaaaattatttttaactaaattaatatgtaaatgcagttgatcaaaacaggtggactgcagcaaaggcagtggttaaagggaattcatatcattattaagcattaatgcatttattacaagaaagatacaaaattaataacctaagattatacgctagcaatattagaacctagagaaagaagagcaatttaaacctagagtaatcagaacaaaagaaataataaaattacatcagaaatcaataaaattgagaacaggaaaacaacagagaaaaatcaacaaaattaaaagctggttcttgtaaaaggtcaacaaaattgacaaatctctgcccaggcaaaccgtgtgaaaaagaaagaagactcaaattaccaatatcagaaatcagagagtggtcatcattaaggatccatagaattaaaagataataaaggaacactatgagcaatactatgcccacaaatttgataacttagataaaaaatgaacaaattacttcaaagacacaaaccatcaaaacttgcataagatgaaatgggtagcctgaatagctctatttctagtaaattattgattgaatcaataattaataacttccccctcaaaaaagcaatgggcctagataattttactggtgaattctatcaaacatttagggaagagatgattccatttctccacaatgtctaccagaaaattaaagcacaggtatcccttcctagctaattgtaaagccagcattaacttaatactaaagtcagataaatacaggaaagaaaaacgacagaccattttctcttattgacatagaaacaaaagtccttaacatattatcaaatggaatttaacagttaataaaaagaattatacaccacaaccaaagggacttattgcacatatgcaagcctgatacagcatttgaaaatcaattaatgtaattcaccataggacaagctaaaggtgaaaacttatacgatcatatcaatttgtgacaagaaatcattagacagaatccaaaacttatccatgtaaaagaaaaaaaaactcttagcaatctaggatcagaggagaactttctcaacttgatgaaaacatctacaaaaatactacagctaacatcattactaatggtagaaactggacagtttctctctaacatcagaaataaggcaagagtgtcctctttcacacttcatttcaacattgtattggaaactctagctagttcaataaggcaaagaaaaaatgttatacacattggaaaagaagaaatagttaaaattgcctttgtttgcagatgattataattgtctacgtagaaaatcccaaagaatctacaaaaacactcctgaaatttaaaaggtagaatatcaagtttataggatacaagctccataaataaaagttaattgctctcttatttaccaaaaatcaacaattggaacttgaatttaacaatgccattcacaatagcagcaaaattggaaatagtgataaatctaacaaaatatatacaaaatctgtgagaaaaactacataacactaattaaagaaataaaagatttaaaaatggagagagtccatgttcatggactggaatgctcaatgttttaaagatgccaattcatcacaactgaaaaactgaactaaagattcaatgctataccagtcaaaatcacagaaagctattttaaagatactgaaaaaatgactgtggagtgcatataaaaggaaaaagatccagaataaccgacataataatgaaggataaaaacaaagttggctttaggaggccgaggcgggcggatcacaaggtcaggagatctagaccatcctggttaacacggtgaaaccctgtctctactaaaaatacaaaaaattagccagacatggtggtgggcgcctgtagtctcagctacttgggagtctgtggcaggagaatggcatgaacctgggaggcggagcttgcagtgagccgagatcatgccactgcactccagcctgggcggcagagcaagactctgtctcaaaaaaaaaaaaaaaaaaaaaaaaaaaaaaaaccgatttggaatatccacactgatttcaaaacttagtttcaggctgtagtaatcaagacagtgagtactggaaaaagaacagagaaatatataagtaaaacagaaaagagagtccaggtatagacccacagagtcaattgattttagacaaaggagcagaaacaattcagtagaaaaagaatagtgtttttcatccttatttgttgttttaacacaacacaaccaattgttatgtaaaaaagaaaggcctgacactacacgcaggtcttattagttttcacaataattaactcaaattgtattatagacctaaatgcaaaatgcaaaatcagaaacctactagaagaaaacataggagggaatctgtctgaacttgtagcccacgatgggttgtcaggtatagcactaaaatcactagtgcaacatgaccttacataccaggatgagtttgtagagatagcactaaaatttagaattaccagtattacaaaatgaacctttatacatacgtatttcattcttaccagaacagtggaaacacttgcacaaagctaacgcaattgtcttcatttcacttgatgcacacactctctacctttggctccctgatgagtaagcaagggctgggaacaaaagcaacaatgggttgccctatctgcctttcctgtggaagagaagcaggagccaactccaagagttcccaatggccaaagataaaaccatttcagaaaaaaaaaaattgaattaagtaattttatattttgagattatatcccaaagtaccaaaaacaaaaaacaaaaaaacaaaaaaaaaacccactatgggttcatgctgatgtaaataaataattgaataaataaatagaaacatcttccctgccaagaattccaaataatttacgtagatactttagcctgaatgaggtggagcataacactccactccttcagtgggggccacatttagtacatttagtaactgtttttccaaaaagtatacaatgacaaagggaaaaatatgagtcactttacaatatattttacatcagcagtgatgtcatgtttatagtgtacacacttaaatgtatattattaactgaaagaagccactctaaaaagcctatggagtgtatgactccatttacatgacactctgaaaaaggtaaaaagagatggtaaaaggatccatggttttctgacgtgatgacaacagcactttccctttgtgattttcctcccccaaacccataacctcagactaatcaggagaaaaaaaaaaacgttaaacaaatcctaattcaggggcattttacaaaataaccaagtagtactcctcaaaacggttaaggccgtcaaaaacaagaaaagtttgagaaactgtcatagtctagaggaccagaagaggtgtgatggttgataataagtgtcaacttgattggattgaaggatgcaaagtattgttcctgcgtgcgtctgtgagggtgttgccagaggagattaacatttgaggcagtggactggcagaggcagaccaccctcaatctgggtgggcaccatccaatcggctgctagtgctgctaggaaaagcaggtggaagaaggtggaagagcagacttgctgagtcttccggcctccatctttctcccacgctggatgcttcctgccctcgaacctcagactccaggttcttcagcttttggactcttggacttacaccagtgctttgccaggggctctcaggtcttcggccacacactgaaggctgcactgtcagcttccctccttttgaggctttgtgactccgactgagccactactggcttccttgctcctcaccttgcagatggcctatcatgggacttcaccttgtgaccgtgtgagtcaattctccttaataaactccccttcacatatacatctttctattagtcctgtccctctagagaaccctggctaatacaagaggcatgacaactaaatctaatgtgatgtcttggatggaaccctgggacaggaaaaataaaggaaatcagaaagtattgacttcagttaatattaatgtatgttaacttctttaatattaactgacttagctaatattaaccagtaccaatattggttcattggttgtgacaagtatatcgtactaatgtaagatgtccaataatgagggaaactggggggtgggatatatagaaactttttgtactattttgtgatttttctgtaaatctaaacctattctaaaataagattttttaagagcaaattacaattaaaaaatcactctactgcataacctgtagtgaaggtctgtgcagcatctcaaagaaacacataggatgaagaagccagagacgattttacagacccagtgacccttcttctcacggagacttgaagaattagtaggagtccaatgaggaagaaggcactgaaaggcagaagaaggcacaaaaaggcccctaggcatgtggtggctgggcacccctgataaagtgcagttcatctggcagaactacaagttgagaaagcctcaggccggagaaggatgcaaggctgtgtccttcctgaaagtccttattggcatttgttcctctgagaaggcgaaatctttgcacaggtttaagtgggaaagtggcaaaacaataagagcctcattcatttctgctgtgttccagatacgatgtcagatttttcagcttcgttatctttgatcattacaaaggatccttgtatttacaaggttagagtttgttctttaggagatcattctccaaatctggagactagattgaaaggtagcaaggctggaggctctttgcggaagtaactgacacatcttttcatcacttcttgtctgttggcttttgtcagtgtgcttgaaaataatttcagctgtttcatgtcatggaattagatatgctttgattacagtttctgctttcttgccttcacccaactcactccttagtgatgctctgcaggacgacttttattctttctctataaagaaactgctcctctgaactcaccctgcccaagccctgcctttacattatgtatacgagttcttccagtcaaactggatcacttagtgacttggagcaggtggcactctcctccgtacctctcctttaacatttatgtatatgtcaaaaagcttccttcttgcttttcttcactgggtataattctgtccaattccctgggtccacccaaatacagccctccctcatgagaccttttctgacctcctagagcaatctatccctccaatgagccctaaatgcctgatatcttttactgtagctaattgtgtgctgttattagcctttcctatacttttcataaagatcttgaaagacaggcaggcacgctgcttaaactctgtttgcctggccgtgcacactttacacctggtataagcagaacgtatcatttgaactgaaaataaagtaagaaaaagtaaatttaactttaaaataaaacacttatttcagagtggttctttgatacttataataaatgctcactttgctttgatactggatatgactaaagtttactttatttggacggatatattacctttgactgctgaattaaaagaatcaatgccttgatttaagctgtgcagctaacagtagctctgagaataaacaagaggaaaatacagccatgtatctcatgcatgagagatgcatcttcggtgatttcatcattgtgcgaacttcatggagtatacttacacaaacctagatggcacagcctactacacacctagactatatggtatagcctattgctccaaggctacaaagctgtgcagcatgtgactgtaccgaatactgtaggcaactgtaacacaatggtatttgcatatctcaacatatctaaacatagaaaatgcaatgcattactctataccattatgatagctacagtatcactaggcactaggaaactttcagctccattataatctcatgggaccattgtcatacatgctgtcctttgctgaccgaaacgttgttatgggatatatgactatatataatttttatgtaagaattttacatttattttttattttaaaaaggacacttcaccataacatcttgataatttattaaattgcaaatacataagatgataaaaaatttcaaatgtcatcttctctatttttaattaatgcctagtgagagcataaacattatttcaacctaccagtccatattttaaaatacaagttcacgcttaaatacatttggagtgaaaaatgtctaaaacatcctaggcatggtggctcacgcctgtaatcccagcactttgggaggctgaggtgggtggttcacctgaggtcaggagtttgagaccagcctggccaacatggtgaaacctcatctctactaaaaatacaaaaattagccaggtgtggtggcgtgtgcctgcagtcccagcctctatggaggctgtggcttgagcctgggaggtgaagattgcagtgagccgagatcacatcacagccctcctgcctgggtgaaagagtgagtgagactccatcccccaacaccaaaaaaaaaaaagtctaaaatattgatttgcttttcttcttcttcctcttcttcttctttttttttttttttttgttgttgttgttgttggggttttttttgagacagggtcttgctttgtcacccaggctggagttcagtggtacaatcatggctcacttcagtctcaacctcctgggctcaagccatcctctcacctcagcctcccaagtagctgggtctacaggggcacagcaccatgcccagctaatttttgtattttttgtagacatagggtttcaccatgtcacaggctggtcttgaagtcctgagctcaagtgatcttcccgcctcagccttccaaagtgctaggattacaggcgtgagccactgtgcctgggctgttctttttttttttttttttttttcccagaagtctttgaatccaactttaaaagccaagtgaaaacctcagaaaacaaatgaagcctgagatgagactcatggaacttgattccttacccgacctatttagaagacattccttaacctatgtacagtcacttaattctgcccatgaaaagcaatgttgcatttcctcacagctgaaaatacttttaaaagaaagtaactataataaattctgaaagtggaaacttaatttataaaagcaatgaagcttgagacctaactttgtgggaaaacaatgcaggtatcttttttcacattaaaaatgttactaatgaactttagtctgattacaaagctatctgaaggaaatagcatgccaagtgcaattatgaatataggtaagttggataccagaatctgttttaattaagtaaaattatgaaagtgggataaaaggacaaaagctctgaaaaacaaatggttgattccagaaatttttattcagataatgaataagacagctaattatttggatcatttagttattgattaaaatggtaaaagtaataaaaattatctgtaaagtaatgtatataaatatagccaattagaaaaaaaaagagcaaagttgctggaagaaataatggcatcaaaaaaattaaaatatcaccatttccttcagctaaagattatgcaatggtagaaaaacatactataacagagaaatgagtttcatatcaatattttacttccttttttaatctcctctgccatctcctcctcatcagataatccaaagtgatgtcatgcaggggtgacagtttgtacatatggatgaataacatcaatgtatccaccttatataaaataatctattatcagggagctcaatttagctttattggggtctttagaaatttactattaatatgtgcatgtttattttcacttacttcaaatgaaaattgctttttcaaactattgagatgccaaaatataccagatatagaccagaaatgtgtagcaatttgctacctattgtcatactctagctaactttaaatttctaacaacccctgtgaggtctacaatggcaatgcgcaatggggaatgcaaaatggcttaaatggcatttggcattgaactggtacctttctgaggacaacagtttatagggggaagaacagtttcaaggacattaagaggcagcagagagttgcaaattcagaagttttatcaacattgattctgagattccacattctatctttaattgatgattatattgtccaaaacttttcactttatgcaagctcagagagaaaaagagagaagaaagtgagtaagggagggaagaaggcagagaggaaggaagggaggaaggaaaataaaaagagagagaagaaagagagagagagaagaaaagaatctgcccttaattttgctaccttcctaagtgcgaccttattgcaatttgctccccttccttttgagttcatgcctcatgaaagagtattacacacgtatgttccttactttcaactcccaaccccttccttagctcaccgtacttgtcttcttccggcagaagtctactgaatctgttctctcaaaggtcaccaatgacttcctagtagaaaagttctaccacttccccactctctcccagtcttctctgcttaagctctggtgaatctcccttcctggagccctctatgtggctgctgtcacgctctgtctactctgctatctttctctccggctcctgacctagttttccctaccttctgactcctgctctctatggttaaaagtctcttaaaaatctatctctgctgtagcttcccctttcctttgtttctctctatattctttcttccttggcaagctcatctaatttaaaaggtctgcttaccaaatgtgtacctcagtcatcatttattcaatgtaggagaacaaaacccactagacaaggtgccagctctgtctataggaagtcagtagtctatttaataggtgaaactggcaaatcaacagacacttaactacacagtctaataatttcaacagggaaaaaatgcagtgtgttctggaaaaacattaaaggaagatccaatctaatcttgggagctcagggagatttcctggaggagttgatatttaattcaagttctaagtaaaaagacaggagtatgaagcaagagaaggttccaagcaaagaaagcagcatatgcaaattattgtgattagggatataatgtcatttgagaaaccactatcagttgggtggcttgaagacacagcatgggttgaaaagtgatctgagcagatgcaatgatataaatatggctatatcaaaaagggttttaaatataagctaaaacgcttgtttgaacattatcctgaggaaaatggggggatctattagttattgaacttcagaagagacatgattagatctgagttttggaaagatcattatagatgcagtgaaatgaattgactggtgtgggaaaagaggaaaaggaatatgaggtagaaaacagtggcagttcctagtgagatgtgttgatggttggaatgaggagtgagatagtgggagtagagagaggtggacagatctgatatttaggaggcaaagtctgcacagatttggggatagaagaatttcgtccatttagatttgttcagtctatgagatgcccatgaaacgtccaagtagagatctatagcagacaagacagttggccaggagctcagaagagagtccagaggtatatttgtagtggttatcataccaacaatgggcaaaataaggaagtgcataaactgtgaagagccaagaaataagaaatctcatgcctgggtctccaaaaccctgaaagttaagaggcaaatagagaaatctgtgaaaggtactaagatggagggtgatgaagttatggcacaacaaagaagagagtaatggaagctaaaaaggagtgaaaaatgctgcagtgaggccaaattgaggactgagaagtaatcattgaattttgcaacaagaaaaatatcagtgatcacagcaaataaggtttcagtgtataagtgggggatacacaccagattccagtgaactgagaaataaacttgagagagaggaattaagagacagtaaatgcagctgagtttgtgaaaataggagagacataggagaatagctagcgtggaccatgaatcaatgtaagagtgtattatgatgggagagaactgtggtgagtaagcctatacagatatggctggttaagatataaaagtgaaatataagaatgaaatgttgggcatggtggcccacgcctgtaatcccagcactttgggaggccgaagcgggtggatcacttgaagccaggagtttggggctgcagtgagctgtgattgtgccactgtacttcagcctaggttatagagtgagaccctgtctcaaaatgaaaataaaaataaaaagggatgaaacaacactgaggtggtgagagaggatggggtaagaagcacagggaagctcaacacagacagcaagagaagcaagaatgggtgcacacagagtcaaagtgtatttgtaaagcagagcgagttaaaacattagagacatttcctccttgctttctatttaccctgaaagattatggtctgatattgagaatgactgagaatgtagcatgccagtagaggaagtggagaaagctttgaataatcatcccactaaataggagatcgatccgattacagaaaggattgccaggaagtcaggaaggcctgattgaggttgggaaccatgacatcttggtagcaataatttataggattgagtgacttttcaacagcgacgtgcagaatttcagatagacacgggaatacaacaagattgatccaggatcagaaactctcttggtggatgcactgggaaaccaagactggaggaagttgagagcatttgtgagttgtagtgtctgatcgtttttgctgttggtgtaatgatttctttaatgtcactcttgcctgtaagaggggcagtgatgtgtttattaatcatcactgtacctccagtgcaaggatggggacattttgtgtgtgcattaacaatttattaaacgcatcacagtcctacctgcaaacctgatttatttggttactattttatcaccctatcatattgcagagattttttaccttgtgaccaaccaaaagtgtattttattcgaacttaaggcaaaacattttgacatcagagatgaagagacatcaaatctattttttaaagaggtcatgaaaagaacatccctttgtctttcccgacactccatttatattacatacattttcctttcggacacttgttctgttctgttctcttgggtaagtgtcatgtgtggtttaaactcagggctcttccttctttgtggaactttatcagatacgttgatggtgactaattagatgtttcaacttcaaacaagttaatgtttcaacttcaagttgaaaagattattgcattgaactgtactctttacctttgcttctctcaagaaaatgtttatggccctattttcttattctcatatgtttgcttcttaactgtttaatgatgtcactgcctctcaatcaactctctcctaggcctctactgtcctcattaattgcagaatataattccacagaagcccctttatgatgctggagaattttcacataatttgtatgatagagtctaagtaatacctatgtttctgtcccactctttactttgaaattttgcacctccctgccagtttgcttgcatctttttctctgactttgcatgcttgaaatcgattatttggtaaaatgcctcaccttccaggtacagaagtgtccccaaccacacaacattatttgacttttagtagtagttccttaagacatgtccccagtatttccttacagcaagtgctcacgtaaagcagacgaatatttgacaaaatctgcaggagacacaggtggagagtgaacgaggctcacaagtggctgccatcagcccttccttcccggcagcagtgtggaggggccgtcagctgccagacacttcacactccactgtttgctcccgtttctcttgtaaagggctgggtgggacagcaggggtgtgatgacatgattcccagtgacagaaatcttggctcctgttggctctaagctggacagacaagaaactggataaaaattcttttaataatttgtttccgtttacagtaccacgtcagtgaccacaaatttattaggctgctcttggacatctgttagtaaatcgggcacattcatcaaatgtgaggccccagatgggagctggaaagcattaataaaatgcagccaatgttcacgaaaaggcaaggcagtggaaatttacctattgtagagggaggaggtgctctctgtgcttaatagctcttcgtcgtatacccgactgagcagaaatatctcagtggagcaattctgggatttatgtgatgcaaccacctaccatctttgtcttatctcttacttttcacaggcatgaacctgtcattctagaaacactaacctactcattctccctaaactatataaaaaaaaagtctggatatgctatttttctaagctggaagtaaatgatccgaccttgaattgtgattaaaaaaagattatttgcaggatgtcatgacactttacaatggcttaaatttttgaaaaacttaggaaaaaaaaatcaaagtataaccgaaagcagttgtttcagttaatatgacattattttaggtttagagataaatttccagcagaagaatttgtctctttatgatttgtatgaattcttgctatggccttgctgttcctctgcttgggttttctctttatgatttgtacgaattcttgttatggccttgctgttcctttgcttgagttttccagaacgccacaccatttcagtccacaaataatggtttgtttctaagaggagctactatttgctcataaaactcattttctatggaataaaagcagcctgtttaggctgattcagaacctgtagaacattttcctgtagttgggcaaccgctctccttgcttttacttagagaaaaaattgattaatcgaaacctatggataatagctttgggaagtttcattttctatttgtaactaaacattttctatgtcatgaagggtcaagggaacctagggtttttcactttaaggtaaacctccagttacagcttaaactatgaacgtggaaatgtctcctatattgttaagtaaaatatgcaagataaaacaatctatttttttaatgttaatattctctgttaagtgcattcaattcaacaatgtttactggttacccaacatgtgtgaaacactatgtaggggttagggacaacacaaagaacaaagtccttctacttataaagctcatattctagtgaatatgtggctcagacttcgggaaatgtcctaagtcagaccatgatgtgtcagtgtgggacagcccatgcccctgtcaacaggggtggtgtttgtcatgtcaagatatccttggaagtggtcaatcttaaattgttcttgaggtcaatctgacagtcggatatgagactttagaaagcgtggctaagagtaaaatgaagaaactgtttactctttttcttccactaggagtcacttgagcccagactctgggcctaaatatacctacaagattttagtgatattggccactgtcctgagacatgagaagagcctcagagaagtagcttctaaaagacacaaggatagatctgggctgggaaagggtcgtagttaccctgtgtgctgtgtttttcttcttctatccctggagctcaacaaaaccttgtgaaaagttagagtctgagagatcacggaggaagtctgtgaagtggtacaggctgcgtaataccccgggcacaagcagtgcccttggctagggtcaaagtgattgtgccaagaagtgggggggggggggaaaaggctgtagcaagagtatgggcttcacaggccgctgagggcaaagagacatgagatactggttcacgagaggcccgagaaaatgaccacatatggggagtaggaaagacactgagtggggctcgttccaatgataaagccagagtgggctcaggccttcaaagaagactggacagacagatgtgctagaattttagctatggctatctcagggagcttttcgtgagtgctttttattttcttctttttatttttttcatgtttcccaaattcgaaattacaaaaagcaaattagagttattgcttttaaagaatccaaaatgttttaagaaaaatgtatacattataagtaactacatgtgacatttgactcctgtccctaggcaggggctgctgaaacatctaccaaccaatatccatatccaaacatccaatatccaaacaaccaatatccaatatcccaggaagacttggcagatcagttcgtgagggccaagggttcactgatggtgctgccaaaagtaagaataaagatggggtgcacccatcacttctcacacaggaagcccatgactatccacacatacccgtgttcatggatgaaccccagcagaggaagaggtgaatgtcatgtttgctaaaacaaatgagtaagcctcaggcctttgaaaaccagacactccctcttcctacgggcattcagtagaagcaaaatgctactgatgcctggcagatcccttccaaaatttggtttaaatcaaaacagcagttattacccgaaaataacacaaatcacaatctgagcatgtgcctcctgtgaaatggagataatcagaattcaacatggtgcgtataatgtactgtaatgggcctcaaagcccaggtattagtgagcacggcaggaagcaggaattctggataattcaagaggccccaatcacttgaatttaatataactgcaaaattaaaaaaaaaaagcattttagtctcattagacttgcagcctccctcacttaaaggggaattttcaaaatttgaaaatcgtatcagatgttacaattgaggtttttagactcattatttttaaaagggtgaccttttactgtacagcaggaacctgtcttgtgtggtttgagacaaatgacaatgaagagatggatatgttcctaggatcatatttaggctataaaacatctatcagtgcccttatcacactttttgtactgctgtagttagcatctcctatcattattagctgtgataaaagaaaatgtttcatgaaatatgacatagaaatagaataagcagcattgttctcaactgaaatacaggagggggaaaacctaactcattcctcatctgggaaataagaaataccgcattatctttaataaaagataaagggacctgacttttcagacagctcttacacaactatctatggccgcttctgggtaacagatataatcgtacatttctctgtcattttctgagtggctaccctgatgaataggcacatccttagatgatatcttctgctctaggccttattagctttatccagtgctttttacttttcttttcttttcttttcgtctattcttcttcccttcttcctttttaaggaaagttgcttatgtcttatttctttgccaaaggaaattcaagtcggcttataaaaggaacacatatatgcagaaaggaaagtgaggctctaaaaagaagaagaaagcaaagaggccagccagctactggaagaatcagacaatgccacaggacaattgtgcatcgtccatttggtctgtgtagccatgttcatttttgttttttctagtggacagtgtagaaatatcaagctctgctgtaataggagatgttcctgtgtgtaattaaacacatctccaaatgtccattgaaccctggcctcattatgtttgttcaagttctacaagataaaagacagaaattctaattagatttccagctgccttttgtattttccttaatagctgacaactctaataaacaatatatatttaaaaaaccaatcagataaaaatgagagaggtcacaaaactctgggactggcatttatagatgcatgtgctgtccagcaaaaaccaaaaatggaattaggacagacagatcacctgctggtctctaacaaacgtactgtgttggcatgatgccgacacaccaggtatgaatcccagctctgctcctcggttctgctgggagtctcaggggcttcatctgtgaagtgaaggtgacatccctcgcctggagcagtgttcatgcttttaaatcaaatgtatctgggtttgaatactggttatctctcctattcgcttcatgatctgagacttacatttttaaatatttcttcaaattttctttcttttctcttggagttcagaataatatatatcaagttctcaacatgatgttcagcacatagttgatgctcagtaaatgtgagctttcttgcccccttcctacttacaagaactaaatgaaaggacaacatccagcatggtacctggggagacccaattgattaatgctcatgtgtgatagttcttttttgctggaactgcaatatagtgatagaggtgggaagtgaaggcagccagaaactcaaacctgaaaaagcctttatcaacgggaaagatggtctgaaataatggcagacatcctgggggaaataccccctactttggcaatgaaaacttcaacgtatggccttcatgaagacctttcagtacattctaggtttggggactttgttgtgcagagcaattggataattatacaagtcaatggaaacaacagtcactcgttgcattacagaatgcagtatttaaatgcaaacgcaacaccaaaaacaaataaggtggggagtaaaagaaaagagtgtggctagcttctaggttaaataagacagttggtcccaacaggttggatgtgacgggactgcactggatggcactgatcactttgaatggcagacatcacagagcaacatgtgcagacttctcactttctgtacactagagcattcccaagaggcaagaggccaccaaaagagagattcttggtgttgttaaatgtgtaaaatatgccaggcagagtggcttacacctgtaatcccagcactttgggaggccatggcaggtggattactcgagatcaggagttcaagaccagcctggccaacatggtgaaaccccatctctactaaaatacaaaaattagcgtggtggtgtgcccttgtaatcccagctacacagggagctgagacaggagaattccttgaacccggggggcagaggttgcagtgagctgatattgcaccgctgcactccagcctgcatgatacagggagattccgtctcaaaacaaaataaaataaataaataaaataaaaataaatgtacaagataccataattttggtggctctgctgtagactgaatgtctgtatcacccccaaattcatacgggaggtgattaggtaatgagggcacagcccttatgaatggaattagtgcttttataaaagaggctccagagagctcgctctccccttctaccatgtgaggccacagcgagaagacagccatccatgaaccagaacgcagaccctcagcagacacaaaggccaccagcaccttgaccttggacttcccagtttcccaaactgtgagaaataaatctttctgttgtttgagccactcagtctattgcattctgttatagcaccctgaatgaacatagatagggtaccaacagaatataggcaaaaataaattcctcccttctaaagaaaagctcctaatacgctgaaatgaatacacaaagaaaactatagttcttgctcatctcacatgaaataagtagaactacatataagattccctgtgtacacaactaggaagctccagctgcagtagccagggtgtgggatgagagcaggtacccaaagatatgaggactttgtttgttccttaagcattatttataatataaaatgcacgtttgcaagatgaatgtttgggtaatatctattatcttgaaactaggtcaaatcaatcaatcttgttagatttatacttaatggctccaaactatgacttcttgcatattatcatcagagtgttaaatatatctcagaaacctagaatgtttttatatagtggtctactagcactggaacgataataaagcggtcatttttattgatctcctatggacatgacagcttgctcagtggacaataaaatatatattttgtaggtttataggtttgtaagggtcttaatggttatttgcaagggatattttaaatgcttctaccgcttccctctactgaagcaagattgttgtttgaaacaatttgaagagcatacagaaaagatctgtttttattgacctgtaatatacgagttgaaatacataggaaattgctctaacaaaatggagtatccagaatgcaacaggtaaatataacatcaaatccaaggaaatacattactttattccaaaagacattatgtaatgtacctttgggtcagttgggtccatgcctctcttatggttgcccgccatttatgcaaaagcagaatccaggtctgaaatagttgttcaaaaaggtgcaggacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgcattagtgggtgcagcgcaccagcatggcacatgtatacatatgtaactaacctgcacaatgtgcacatgtaccctaaaacttaaagtataataaaaaaaaaaaaaacaaaaaaaaaaacccaaaaaggtgcaggagtctggtgcagtggcttatacctgtaatcccagcaccttgagaggccaaggcagggagatcccttgagaccagagtttgaggccagcctgggcaacaaccccgcctctcaaaaaaaaaaaaaaaaaaaaaattaaaatcaactaactaaatgaataaatatcagctgagtgtggtgatacatgcctgtggtcccagctattcaggaagcttaagcgggaggatcacctgggcctgggaggtcaagggtgcagcgggccgtgattgtgccactgcactccagcctggacaacaggagaaagactccaattaaaaaaaaaaaaaggagcaggcacacagggtacaggttgtacctactgtgcttttatttcaaggtttttgtgtgactttagatattcacaagtttctctcctgttaattttctggttgtaaattgatgagatatctgcctggctacttcatgatattgatatgataatcaagtaaaataatttaattaaggctgggggccatggctcacgcctgtattccagcgctttgggaggctgaggagggcagatcacctgaggtcaggagtttgagaccaacttggccaacatggtgaaaccctgtctctactaaaaatacaaaaattagcggggcgtggtggctaatcccagctactcaggaggctgaggcaggagaatcacttgaacccgggaggctgaggttacagtgagccgagatcacgccactgcactctagcctgggtgacagagcaagactgactctcaaagaaaaaaaaaaatctaattaaatgatttggaaaagcataaaacactttataagtccaaaacattatcaaagataacagagacattcttttttttggagatggagtctcgctctgttgcccaggctggagtgcagtggtgccatctcagctcactgcaagctccgccttctgggttcacgccattctcctgcctcagcctcctgagtagctgggactacaggggcccaccaccgcgcccggctaatttttttttctattttcagtagagacggggtttcaccgtggtctcgatctcctgaccttgtgatccatccgcctcggcctcccaaagtgctgggattacaggcgtgagccactgcgcccggccagagacattctttactttctcagttctgatgcaccctcatgttcctagggctgtaatttcattggcagtttaactaaattcgtggaatacaaaggccatttgtaatggagttttattaaattaattaacaagatttagagcactttcttcttcagaagacttgtggcaggcttgggaggcagatgacagactctataatggtgtgcacaatggattgatttaattcattcggtgataattaagttacttgatccagttgtttgatggtgtgtaagcaaaacatctggttgatttgcctgaatcttgattttcactggtatttttacaacagatattgcttctagaggaagaaactttgcaggtatttgtcattaagtttttatcctagataaattatatttatccttaatcttattcttctatctgcattttaagccattttgtttacactgggttttgtttagataaaaaacaattcatttaaaatttctttctgttcacgttctcacatccatttaagagagcacaaactgaatcatcagttaccataaatccgatgccacttcagtgaattcccatcagtcaaaaaaacaagtgattattgagaattgattgaccgtggcacttcatttgatggctggagagggtatgtgtcctctgccattatgttgcttagattcaactgaagtgatgagaccaacatacataaaataaaaaatataagataattaaactaagcaacagataaagtagtatcaaatggaaatattctttcagctcatggcaaagaaaagccaatgggggctgaattatggaagaaaggctcatggaataggctgtatttgaagactagtataaaagttgtatgcatttctaaaaaattcaattcagttaaatgtgcttgcacatattcagagttttaaaaatttggcctacataaaaatacaattaagattctggcccacttgcatgttgattcttttaagtatcacaaaacatggtattaaaagcacttttcagaggaagggaaaaaaaaaaaaccagagaaattaatttgcccaatgcctgtaaccagtaagtgcttgaaacaggattgaagctcaagcatgtctgcaaagctcatgaccctcttcaatgccaggattcctctcaaggaatgctgaaaactcaagaagcatgggatgatggagagaaggaaaaaagatggagcaaatagctgccactcaaagaacacagaaatgcggccgggtgcggtggctcacacctgtaatcccagcattttgggaggccgaggcaggcggatcatgaagtcaagagatcgagaccatcctggccaacatggtgaaaccccatctctactaaaaatataaaaattagctgggcgtgctggtgtgcgcctgtagtctcagctactcaggaggctgaggcaggagaatagcttgaacctgggaggcagaggttgcagcaagccaagatcatgccacttcactccagcctgggcaacagagcaagacttcgtctaaacaaacaaacaaacaaacaaacaaaaaaacacagaaatgcataacgttccttgatacccaggagtgacagcaagactcatttcaaatcttagcctactcattagattgagggtcttaaagtactattctccctggtcagcatcactagatgagcttagtcaggatgactcttacagtgagaggcagcaaggggcacaaatgagcaaggtcatgtcaaggaattactgatatctgtcaataattttgtgaaggatccagactttcttgaagctttttattttgataaatttgctcaaaatattatccataattaatatgacatgatattagtcataaagcatgtttactaagaaaacaataaatctgttctggaagataaattttgcaaactcaacccgaaggatagtaggacttatcacagaagggcaggtttaaaaggcagaggaaacacgaacgtggaagaacgttgccagtaatggccccaatttgctcacacagtcctgcgtctgtgcattgtatagtccttccttacagtggctttggacttgtccaggggatttgtcttagtggatgaggcaatagcaaatgtgacacaaacagaaactcacgttgtgcttgtaaccctgagaataccattgtaagaagccagtgctagaggctgaagggcaagagaatgaaaaatatttagctgacagcttaccaagtgccagatatgccaaaaatctaagggagcaatggagttactttcatgtaactgagagtaaaatagcaaaatagcacagggctttcagaagcacagcacagtttcctactttgaggtctgattagttgctgtgcccccagagtgagcctggctaaagcaaagagtgtcaatagctaggaaggggctctgccaatgggaacatgtaacaacatggaagcaatggggtggactgtcaacagaagacattagtggtggatgctatgcttcttaatgggtgctgtgatgaataactttatacgtcaacctggctaggacactgtaccctgatatttggccaaacaccagtctagatgttgttgtgaaggtatttttggatgagattaatatttgaattagtagactttgagtaaagcagattactcttcgtaatgtgggtgggcttcatcccatcagctgaaggccttaagagaaaagaaacagattttctccaaggaagagggaattctgccaccagacctccttaaacatgaattcatgcctaggtctccagcctgctgtcctgctctatgaatttcagaagtaccagttctcaaaattgtgtgagcaaattcctcaaaatctctatctatctatctatctatctatctatctatctatctatctatcatcgatctatcatctattatccatctatctatcatctatctatattttctatcatctacctatcatttatctatcatctatctatctaccatccatcatctatctgtctatctctttatcatctatcatccatctattatctttctatcatccatctatcatctatctatctatatatctatatcttctatcatctatcatttatctatcatctatcatttatctatcatctatcatttatctctatcatttatctatctatcatctatcatttatctatttatatctatccatcatctatcatctatctatccatctgtacacacacacacacacacacacacacacacacacacacacacacacacattgctttgtcctgtttctctggagaaccttgatgagtactaaatttcaacaatgtagacgtatgttcaccaaggactaaattcttccttccaatccccctgcccttatccaatgattgctgcacattaattttcctccctatgaaatcaaagtagccattttatttaatctttccgccacagtccaattgtaagactaatgcaatttattctgtgttttgcatttgcatgtgaattatatatatatacacacatatgtgtgtgtgtgtatttatataacacaaacacacacacgtaaatacatatcttttagattcttactgatatgattgaaaggtacaaatcaaaatataaacttttgacatgatggcaacatgaagtttaactatcaatgccacaaacaaataattgacacaaataaaaatctgcattggcactataaattagggcagcacgtggtctgaaagtctaaccaatattccatatataagaccagattgcaacattctcctgagacagcaccacagtactaagtagagaagactctaggagattactcataaaaccctcaatgccggagtggaaacagcagaatatatgtgagaaggcggcacaacactttgaatcccattcactgtagtacatcaacagtaccaaaaacagctgcagtggggctgcactaatcaaaccactgcaaatatggacagcttctctccccgcagtggagggcaaacaccacagaagaaatcagccatggccatgtcttggaggcagcttggcaatggacaatgttgaatataggacagaaatgtgttccaacgaagtaagtccatcacactcagtgacaacatgatatcatggtgacatcctgaggcaaggattactcccaggtccagctcgctccccaccatacttagtctgtcaaaaagctaacttattaatgcaaatttacattaaccagaatgccaactccagctgcaaagtggagacgatcccactgacatatacatacattaagtaatctaaggagaatccatccaccctgtcaataactgaagatcagttccatgtagagtccttcatgccagagacaaagtaaatgagaaaaattcacaaaacaaattcacaaatatttctaagacatgcaatggcataaagattataatagtatctatatatacctaaaatactcaacttaaatggcatgatgtaataaagcaatcaatgaaacataacttacaagagaattttatgcttagagtctatgattagaagagaactttctaaaggaaggtagaaatagagaactagaaaaaaataagaaaatgatgaaaagttaaacatgcgataatagatatattctctattagcatctgtaaagggctgaatcggcagtgaagagaattagaattaatgttatgatgtagaaacttaaaaacttaatctggaagagagaagggagagagaaagctaaaaaatgaattttaaaacagagaaaataataatcgagatgtagaaaagagtgaagcatatcagtaaatgttgtttcaaaacaggaaatgagaacgaataagcaggcatatagttagttacaattattataaaaaatacaaaaatacctacaattgccaatcaacattttctgaactattatgtaagagatgtggtaataactgctttacactgtatgtaatacttattaaaccctcaggaaagcactaagtagtagatgttattattatatgcattttataaatgtagaaaatgagcttaaataacaaaacagaaaaaaattttcttcaactaggaaaaacctgaatcaacagacttaaatcagtcaccaaatttgtaaatacatcacagaacaagcaacgaaatggcaatggcccatttatattttgaatttcaaggaaagaaaaggcattacaggtatctaggcaggataaaaaatcagttttaaaaaacagcatatgcacaggcaacaaaacattctgccaaataattaaaggctttgaacaactacatataatcctaataaactgctgggaaaagtattgtagttttccaataagttagttaagatttcttttaaaaaaagatagtgtagcaaagagatgacacattaaattagcatatataaatcaatcattttcatatatgtaaacaataaaaagtatatataggaagaaaagacccacatataataataacacataataaaataaccgaaataagcttagtaagaaaagtgcaaagtctatattttaaaaactttaaagcactcctgaaagaccacatatcaaaattgaagacatgaaaagatagagtatattcttggttagaagacaactctgtaactgagcttgggattacaataaggagtaggtttgagaagtggaaaaatcggggttccattttggttgtgttgagtttgacgtttcggggagaggccttaggcactggagaagtgagtgtggagcactgtggagaggtcagcatgaaagttatgaattggagcattctcaacatatgtcacttagcaacagcgtgtagatgcagaaaggagaggaacctaggacagaaacctgaaccttccaacatttatggattagctgagagtgaaaagccaccacagaagactgagaccaaaccaaatggccagtgaaaaggatggaagagtatgagtgtgaaattctggaagcaaaggacaatcaatttgttcaaagagagaatattcattctgtattcccagtgcctggcccatggtaagaactcaataaatatttgttagatgaatgaaagtgtgaaagaagaaatggaattttcctagaaagatatattttataaaagtgtactcacaaagcagaagaaaaacattttagactaattccatatatgtgtattatacatatatgtaaactaaaaaaaatccaaaattttaacaaaaagttcaaatccatctgtattctaaaataataacaaaatatgactacatgtctaatggtaccaaaatctctgataaaatattcagccaaatgtgtcctggattgctgtaatagaaatgagttattaagtgctcattgataaaatactgaacactaagtctgcaaataatatagactcattggtcttaagtatggtcctgaagatcattcagccttctcctcctgtcttcaaatgggccatcagaacctgctcccatacccagaattagtctcttcttccatcttgccacaaaaccctctttcagcaaattattgacttctagaacatcaaaccatccctagagatcttcaaacgaccacttggctaccagagagcacacaagacagaaactaggcatgggtttctttcttattttaaaacatcttcagggagtttttgatagagttaaaactagacttggcattataaccacttagtctcccttcatgaccagtttcaaaaggcatgattggtttcatataggcagccaccaaagtaactttcataatatcagctacattattaaccacatcaaattgggatcagaatagccaccagattgattcattttccatgtgcacaatctgttacatattcagaacaatcattaatgtttcttaactcttcttgaaaccagtacagagccttggattttgtctagggtgaattacttcattcaaaaaaacaaaccaacaaatcagaaactaatttttcagcctgtcataaatatgactacagaacatgtatgttccttcctggatacatttgacttcatcttgtcataacagcttctaatgaatcttaaaaacttcctcaaagtgttcagcaagcaaataaaatcagttttccatgcacattatagctaaaacaagatcctacctgtaaattataaacaatgattgtttcttactagcttatgatatctgtgaagatttttcctgtttcttagatttttactgaactacaccttcaggttttttttgtttgtttgtttgtttgtttcgagacagagtcacgctctgtcacccaggctggagtgcagtggtgtgattttggctcactgcaacctccgcctcctgggttcaagtgattcttctgtctcagcctcccaagtaactgggactacatgtgtgtgccaccacacccagctaatttttgtatttttagtagaggcagggtttttcaccgtattggccaggctggtctcgaactcctgagctcgtgatccacccacctcagcctcccaaagtgctgggattataggcatgagtcaccgcgcctgacccagtctttaccttacagaaataatactcttttaaatctacttcacctctgatccttaatagtctttgccaatcagtagtttcctgattagccatgactgtgtcaatctattttttagcactgggattatttgtctggtcctatagttttaaaaaaacaggcatgccactgaagtgaggctgaaatgtgaacttggtaagactgtagcttcccttcctattaattatctcccctttcacctggtgataatatgatgctggcaatagctgctttgtctttacctaattgttttaataccacttaatcttcaacaatgagtattttaaaagctcatgtagcaaatgagctgggggtgtacacaggcctttatggacagaatttgagctgcatcttttgatggtattgctttataaagctagcttaaaatgagaaaaaattaaaaccttgcatcttcgtatactgttaattctaaaccattttaaggcaataattaccagaggcaggaaccacagctatgccgagttcctctctatcgatagaagggtgtgttacataggttggcatatcactgaccttttctgcagtcactgtaatgccagcttttcataactattgttttctgttttctcagaatcttctctgaacaatatgcatcttattttctttcagtgatgtgaattgtttgccacgtgtgaaaggttttacatattttaaaaaagccactaaatgtagctgggcatggtggctcacatctgtattcccagcactttgggaggccaagtgggtggatcacctgaggtcagaagttcgagaccagcctggccaacatggtgaaaccccgactctactaaaaatacaaaaaaattagcctgatgtggtggcacgcgcccataatcccagctactcgggaggctgaggcagaagaattgcttgaacctaggaggcagaggttgcagtgagccgagattgcaccactgcactccagcctgggcaacaagagtgaaactctgcctcaaaaaaaaaaaaaaaaaaaaaaaaaagtcattaaatgctttgcatatgtaggatcttgttccaggcaatgcaaagtgtgaactcataaaaattgttcccttactttggaaattagttttctgctacagaatagacacaatgtccaacatggtgaacaggtttatgacttaaatagagcgtttctctctctctcacacacacacaccatgtaggcacgagaaaaaaaatcagaattacaaataaaatactgatttcaaactgtatttaaagatgtagttaaggcaaaattataagttaatgagatgtatgtgtcttatagaaggaaagttcattaattcataatcacttgccataaattatatgtacaattattttatggacatgtatacagctgatccagtctaacgatcaccgatgacctgaatcaaataatatggcagaattaaggatgtgaaaaattgtacaaatatgctaactttcagtgaaatatgttttgactaccataaaatttatataaatgttaaaagcacagttcaaactgaattataatttttcaggaggtttgcttgcgtgccatattaaaatatccctgatgaaacatatttcttaaaaccactaagaaaaaagttcttgcaatgggaaaatgatttatttacctggatcttctatagttaagttctttatcaaccattgaacaatgtctgaacctagaaaaagaaaaaagaaaaacacaaacagatgtgaacattttgtttatacatattaactttaagaattctccacctttggtgctcatattagaaggaacttttctaattgttacaatgacagattaaggatctaccccagatggaatgctgaaaacacaaagtatggatacttagctgtccatcaataaaccaaggtgtaaactagtaaattattaaatatgaaatatgtaaatggaaataaaatttactgtactagtagaaagtgatttgtttactaaataagtgtttattaagcatctcctatatttcaggtacaagtcttagcacagcataaccagtattttataaggtagttcctgtctcatttttggttgtacccacctcatccttgtatcccctctcaagtcaaaccaaatttgtttttggttttcgaaccctcttacgtatttcaagtctctgtgtctccacagcagtactctccctgaccgaaatgtcttcccactatttttaagacactcaagattcactgatatgacagaacttgccttggcccttcccctcgtccactgagttcacagtactgtccatgaaacctcattggaacccatgcagtcttttattgtcgtgttgatcacacaccattgccccagctgtttatttgatgaatgccccaaagtaagaaccttgaagcagggtgtcatattcatctttgattatttggagcatagtaagtgcttaacaatgtgtgatgaatacaaagtatgagcaaatatgtttctacttcacacagaagagacaagagaggtctgcagaaaacaatgtttgagctagattttgaaggatgtatttttatctatgaataagagagaaatttagttgctgaaggggcctacgtaaaaactaaaaggtggaaaagcagtcaacagaaataatttactgcacactgtctatatgtaagtgctgggaataatagaaaattgaaagtaataatggagtgcacagtatattcagcaggtcttgaattctaggctaaagaattaaattttctttttcccataaggaaagcagagaaagagacatgcaatatttttgagcagaagaatgacattatcaaagtaagtttgaggagtatgactggcaatatatatgaaatgccttgtagtcaaaaagaaggcaaggcagtcgacatgtctactagttgcaatccaaggatgaagggaaaaggtcttagttcagtgtacaaaggaatttcttaaaaaattacagacttctttcaggactttacgactaattaggtataaaggttataagtaggagagattaaaaaagaagtcaaggtttctagcccggaagcatagatgaatagaatgatgaaaataagagcagaaatgggagatttagcaactgatttgcttgagacattcatttgtatttaaaattggttttctgcataactcttttctacacaaaataggaaaaatatgtatgtgaattgtttgcatacatagtaaactgtgttatgcctgcgtgaattgaatcaaacttcagtgtgaaccaagattccatttcagcctctcctggaggctggctagagttgctgtctacccacctcggagatttggcaaattaattacattaacattggcaaaataattctagctgcttgaattaaaccagttcaaaatcaatttaagaataaatttgattactaaacttgacaataaagtcccaaaagttatgagaacattcatactcaatgtcaatttcagcatgcatgcatttaaaaaaataactccaagtattgacttgaacttgtgttccttttacagctgccatggatttaaatcatttgggaagacagactcatccagatcctaaaggaagttttactaaaacagctctaagggtcaaatggaaaggagatcattctccagaaggcagttgaccgtgtcccggtgttgtgttcaaccttatagtcttaggttatctggaagcacgatcttcccattgaaaaagaaaaggagaactcagcttttcacatatacatgtagtgatccttgaccaatgtcgattcccagatacacaaatcttccgcacaagccccaagcaccctgctcatttttcagagttgagcatctatttgtggaacatatgtgagcagccactggaaattttccattcttttgaagacagccaaacattcattccaggactatacatattttttattgtgaaaaatgacttgaaaaatgctcttagagactaagtttttaaaaatattctgttctgttacgctttctttccttttctttttttttctgggcagaaagaaatacaaagaagcctaatttaaaagtatgtttaattcagagaataggaaactttctttcttagcctacttttgagtatttctgtcacaagtgtattctcagttcagctctgaaggagtcaatttaattggacttgaccaactgctagtgccacttagcagatgctgtagtagtttttttattgtgtgatcgccccagcatatttatggttttaggttatggatttttaaattgttaaattcttacccagactcaccatgttaacctatgctccatctgtaagagtaagacctcaactccttgaagagataggtagagagagaaagaggaaaaaaatccagtatcttattggaaccagaagactgaaagagaaacgtgctcctatagagtcatcttgagaagcatgactcaaatttaaaatggagcattacagtccagagaagtgtagtaggaatgccacctttacagcaattttccagctttatattaaataaataaataaataaataaataaataaataaataaataaatggctgggtctgctgaagtttttcacatataatgtatatgtagaaaattgtagcattctatttaccttgattttggagccctcaaagtaacctgtggaattttttgaaatcacactttcactgtagcctatggaaagtttatacaggcatatgtcacttttagagttgcagagctttgtgctccgtctgctcagcagaagcagtagaggttttattactgtcgaatcctagcagtatattatttaaaatgaaaacaagcaaaaacaaacaagcagaattcttcctcatcacactgctcatagttttctacctgctatactgtttcttccttccatgattttgctaatgctcttctatcttcatctctttttcctgtggtgaatcccaactgaggccataaagttcaattcaaacattatctactccaggaagcctgttgtgcccacccctcaacaaaagattgaatgaataaatagcaagactcccctccccaaattctattttcacagagtttaaaaagaatagtatccttcatgcaaagaatattctactggcatgtaatttaaacaccactattattttttttttttttttttttttttttttttgagacggagtctcgctgtcgcccaggctggagtgcagtggcgcaatctcggctcactgcaggctccgccccctggggttcacgccattctcctgcctcagcctccggagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggcctaaacaccactattattaaacatgatgttaaattgatcttaaacttcaacattattttttcacccatgccacggatctgaacggcaaacgagcttccttacctgtgccccctgcagagtgcaaaggcctggaccaggctctgtcctaagcctgtattacttccattacggtccacgtctgcacccctccccaggattagagcacatcctcagctacaagtgtcacctacagctatccacaaactaaatctgaattagaggtgcacaaaaatattaagcattcatgaaaaaaattgcaaaatatttgtaaatataagatatgaggactctgtaagcaagcaaaatagaacacatttgatttgcatcctttacaaaactcaagtattttcataattttcagctaaagacattagtgaaaacttgagctcttaatcaccatagaaggtgcgcaaattattcctgaggcaaagacgctgacctttgcaatgtttctctttcagggaaatggaaaagctctttgtactgcccaaatacctttgctgaagcctcagaaccacatagacacagtgctgacaatacaaatatttttatttagtgaatatcataaataatccttaatccatgatttttgatgttataactattcttctttttttttttttttcctttgaagacagggtctcactcaggctgcaagacagtgcaacaatcacctcatcgcagcctcaacttcctgggctcaagcaattccccctgtcccagcctcccaagtagctgggattacaggtgtgagccaccatgcccggcaattttttttaattattattttttggaggatggggtctcgctatgttgcccagacttgtcttgaaatcctggccttaagtgatcctcctgcttcagcctcccaaagcactgagattacatggcatgagccaccaggctcagccaactattcttagaacctctcactaaatagaagactttctatatactaaaaatcatttttccaacattattctttgttccttgaagtaggcacaataaatgtttattatcatcaaatagcatgtaataaacatctattgcgtttctgtagaagtttggctgaggatctgcactttaaggaacaagaaagaaagaatgtctagcgaagcaaattaactgatctgtcagtcccttgagagaagaaacgacatcatactcatcacgtttccaccattctcttcaaagtgcttcaacacagatcatcgttaaatgtttactgaaggcatgagtcactatttatggacatctactctatacagaaaagactccaaatgctgaaaaagtcagctctaatggtgactccatctagtatgttatgacaccacagtgtatctctcattatcataatttaaaaagttcttcatgcaattataattttaactcaatttaatttaaaacacggcagaatttctttaaattaaactcaattgaatttctttaatttttaaattaaactcagtttaaaacactgcagaatttctgtaatttaaaacactgcagaatttcagtttaagttaaaacactgcagactttctgtttgagaaatgaagtgatttgcttaaagctagcatattacccttttgtaaagctgaattaatgaactaaatttctccacaatctttccaataagtaattgctaatatctaagaataacattttgtttatttgagtacttgtgtcctgtccagagccttaaatatgattgcacagccattgtcacatctgagggttcaacaaagcaaccttcaaccaaaggagcaggagagatgaactccagcccagctacagactatgttctctaaccccttgatctaagaaatctcagcaatggcaaaaatctggatatcaccaattaatggccggtgtcctagttctgtctgcctttggccaaaagcgggtactgaaaaaagagaaaagcagccactggcttccaggaactggctgggcactcacagctatgtcttggtgcttccttggtaaatatgaacaatttcttagaagaacattaacaccggacaaggccactctagaaccctcataggtcaagataaaaacaagaccactctgtaatcagatctgaacacaaacaaaacatgaacatgggctgagccataaaatatcaaattccatcctggataacatgagcgactgctgcttctttatcaatgccatatttagtcttgtctaatctgtcctcctgtagaaaaaatgtattaagatacccaatcaggccggccacggtggctcacgcttgtaatcccagcatgttggggggccgaggcaggtggatcatgaggtcaggagatggagaccatcctggccaacatggtgacaccctgtctctactaaaaaaaaaaaaaaattagctgggcatgatgttgcgtgcctgtaatcccagctactcgggaggctgaggcaggagaatcaaaccagggagctcgaggttgcagtaaactgagatggcgccactgcactccagcctggcgacagagtgagacactgtctcaaaaaaaaaaaagataccagataatggaattgtccctacttcctgacagcacccaatctagagcaaaggcccacttcctcagatcctctccatgactaccaatgccaaaatcctgtaatagattcttcctaaaaccctattactgagacaccccatggttcccgatggcgtgcattctccctaccctcaagaaagaataaagttgacttgttcgactataggcgtgttcctggtggttttgggctagaggcatcgacatttttttaatttaaaaaaattgctaatatctattaagattaatataacaacaacaacaaaatttaagttacttcatcagggcgcttttggttgtaaagagtgatctttgagggaagtataaaaacataaacttatcaaagaaggaatttgcaaaaaggtacccagaactaaagggaaaggatgtatttaggcctcaaggactcatggaggcagagactgtcatccttgctcctttctggacatcttcatttctctctaggaaacaacctttgctattttccatccacaaagtgggtcatgaaggctcacagctcctgggttaaaatctctgccactgaagacggcaagacatttgaggctgaaatcttttagtcctaagtcttaattcctgatgaagggtctcagctgcagggaggtgcccattcctgtatcagccaactgtggcaagaaaagatggatcactgtgcataaaaatggtcatgctggcgagaggtatcgatggaggcattttccagaaagaatgagtgctttgcagacataacaatgggtgtaaactacagcttccttccagtttgtaaagcttttatgtttcatcataaaaaaaaatgcagaaaagagaggaaaagtggaattcaaaagcaaaatgtcaaattttgaatgaaacgaatatgttattctgccttgctatgaatataaatgtgttttgttctatgaacttattatagtcccgtaaagcagagtaggaatacattgtttttgtgtatgtgaatgaaaccacactttatgtgcactaaaacagctactcaaagaaacttcgtgatgtgtatatgattttgtgtttttatgagtgggcatatttttaagtaaataattcactttctaaaatgaataacatgtaattgagtattgttacttctggatttttatacatcaggtatatctagagaaaattattcagttttcatagaattaaaaagattaacttctgctcacagtttgaaactggatcaaacttatgatataaagcccttcttccaatattccatagctaataacacctatgaaatctcaaaggtcaatggaaacaaaataatcaaaacagatatgtttcctttcagtaaacctcagatacatttgaagcatttgcctacgagactttaaaaatgttgttcagcagtcatttaaatgcatttgcagatgtcatggcaaaaagcaaattatctggttgattacattttctttctaggttgttgctctttagagttctctgccccttgccctaagagcagagtcacagaaaatgttgggttttgttgatataacttgaatcttcaaatcaacaggatagaagcccgatattcactgtaattactactactgtgttctgaggataggaaaagtaaaaatatatttccctaccctctggcaaggtacaatgaaaacaaattagagttctgtggtagagctccttggctgttccttgagcagacattttctcaagatcatggggatttaactagatttttaatctttgttgtgtaagttccagaaatcataaaaatatctcttcagacgcaaagcaggcattttgtctctcttcaaagcccaagaagctttaaacctaggcagcaaaaacagcaaggcagcaaagatgacaataatgaggagataaaaggtaatggagaccaccctcaggattatttcctgccctctactggagctcaggaggattccttatcaaccagagaagcttttcccaagtcgcattcagagaaacatcacgtctgcctcttgtgtgggatggtgacagtaagtgtgggaaatgcggagttaagagaaggaaggaaaatagggttccttgatgtgcagcctttattttgataaagcaagttgtagaaaaatcaagagaagactaagtccgcagtgtttccttaggatggggatattggatccctttttaaagaccattttatatttttatgttttagttctatggttctttagactcaaagaaaataaaacaagtaataagtgtgtaaaatgttcagatataactatgaattttgggtcagctaccatattggaacacattagaataaattatttattaatcgattaatcaattccatatgctagctggtaggcataaagaaaatcctagtggatcattcttgccctcaacacatatatttttttccagctacacacaggccatgtctaactgtctaactgcctctatgaaggacataggagataaagaaaatgtttattgatcgataaattaaaaacttgctcttgactggataggcacagacctcatcaatctagtccagacacagttgctgtatctgttgacaggtagagataatactttttattctttattagcagagagtaccagcattggtcaagaggtggatgaggcagaaggtacaagtagatcaaagaggattccaattccggaaatttcccagttcattaaagattgacaaaatgaatgcacttatgcatagtcaaaactacagctcaggccgggcgcgttggctcatgcctgtaatcccagcactttggaaggctgagatgggtggatcatgaggccaggagttcaagaccagtgtggccaagatgctgaacctcgtctctactataaatatgaaaaaaattagccaggcgtggtggcgtgcgcctgtagtcccagctactcaggaagctgaggcaggagaatcacttgaacctgggaggcagaggttgcagtgagccaagatcacgccactgcactccagcctgggcgacagagcaagactccgtctcacaaaataaacaaaaacaaaaacaaaaacagaactacagctaaggccaagtgcttttgtgccaatcctaattattttggcactgaacgtgctctatatagtgctatgtatagaccaaggcccagattgaaaagagtgaatctttttaaaaataaccctgaatatttcctgctgtgacaaaatattgaaaataccaattaatgatgccatttttggggttctatttaaaatgttttctattattgaagatgtaatttcaataccatgaggtattgaatgatcacgaggtcaggagttcaagaccaacctggccaaggtgctgaaaccttgtctctactaaaaatacaaaaaaaaaaaaaaatattagccgggcatggtggcgtgcacctgtaggcccagctactcaggaacctgaggcaggagaatcacttgaacccaggaggcagaggttgtagcgagtcgagattgcatgactgcattccagcctgggtgaaagagtgaaactccatctcaaaaattaaaatgaaatttaaaaagaaagaaagagggagagcgagaggaggaaggaaagaaacagaaggaaggaaggaaggagggagggagggagggagggaaggaaggaaggaaggaaggaggaaaggaaaggaaaggaggaaggaagggagggaaagaaagaaggaaagaaagaaagaggaaagaaggagagaaaagaaaggaaggaaggaaagaaggagaaagaaagagaggaaagaaagaaagaaagaaaaagaaagaaagagagagagagagaaagaaagagccaaactattttccagagggcctgagccattttacattcctaccagcgatgtaggagtgattcagtttcttcccatccttgctaacattagtgttcctattttttagttcaacctttctgatagtatgtgttgattttcatttgtgtctgcctggtggctaatggtattgaacatgttttcatatgcttttttggtgtaggtacatccttttctgtgaaacgtctcttcatgtcttttgaccattttctaattaattttttttgctattgttttttcagttctttttatattctacatactagtcctctcttggatatgtggtttacagataatttcttttactctgtaccttgttgttccaccctcttcacaaggtctttttcagaaaaaaaaaaagtttttaatttggatgaggtccaatttatcaactttttatagattatagtattaaatctaagaactctttgcctagaccaagatatccaataatttctcctactattttcctaaattttttttgttttaattttccattttgtattagtgtttgtataagttgtgagacttaggtggaacttcctttttgcccgtgaatgtccaatagctctagcaccatttcttgacaaagctatctttcctcagttgaattgcttttccatgtttgtcaaaaatccattgtgtctatttgtgtggatctatttctggattctctattctgttttattgatctacatgtctatccttctaccaacaccacacagttctgtttaccacagttatataatgtcttgaatatataatataaacataaaataaattcctcccacattatttttctttcaaaattgttttacctgttctacttcatttgctttacctataaatcttagaattatctctatatctacaaaaaaatcttgctggggttttgaaaggaatttcattaaacttgtgtatcaatttggggagaactggcttttatacaaggttattcttcatggatttgaagtatgtctctccatttatttacatcttcttttatttctttcaccagcattttgcagttttcagcatacaagtcctgaacaaactttatttgattaacacctatttaatttttgggcaattttaaacagtattgtgtttttgatttcagcatccacatgttcactgttagtatataaaaatgtaatttacttttgtatatttattgcatatcctgtaatctttctggactcgattcttagttctagaaggtttttttgcagatattttgggatttaacaggtaaatataataccatctgcaaagaggggaagctttaatttcttcctttctgatctgtgtatctcttatttccttttcttgctttattgccctgactagaaatttcaacattatgttaaataaatcctcaccttgttctcaattttagaggaaaacattcactcttttacaactacatataaagtaaacttattattattactattattatttgagactgtgtctccctctattgtccatgcttggctaattttttaaatttttgtagaaatagtgtctcactatgttgtccagccaatgatctcaaactcctggtctccaagtgatccttgcacctcagcctcccaaagtgctgagattaaaggcatgaaccacagcacctggcctaaagtttttgtagatgttctttatcaagttgaggaatttctcttccattcctgttttttgaaagtttttattatgaataagttttgaattttgtctactagcttttctatattggctaatatgatcatgtgatttttctattttatccagttaatttgctggattacagggttaatttttgaatatttaaccagcctgcatctctgaaataaacccacttggttatggtgtataattatttttatatattgctaaattctatttgttatattttgctaaggagttttacatcttaatgaaggatactggtttgttgtgttcttttctctacgttatttttctagttttgacatcagggtaataatagcttcataaaatgaattgagagatattctctcctcttctgttttctggaagagactgtgtataattgaatttttttaaagtctggtagacttttccagtgaaaccatgaacctggagattttgtttttagagatttctaaattatgaatttaattttcttaatagtcattgattgcgctattcaaattatccatttcatacagggtgagttgtaatagtctgtggtttttgagacactgatcagttttgtataagatgtcaaattatgtgtttaagtttatggtattcttttatcctttagatgtctgcaggttttgtagtcatttcccctgcttcattcccgaaaatggcaatttgtgtcttttctttttttttttttgtcttgttacagaactgtcaatttatcaatttttataaagaaccagctctttgtttcattggtttttaaattatttgaatgttttcaattccattgatttatgctctttattattttcttacgcttgcttgctttgggtttattttgctcttcttctatgttctagagtttggagtttagatgattgatttggaaattttcatcttttctaatgtatacatttatgttataaatatttctctcagccctgctttagcagtgttccacaaattgacatgttacattttatttttattgttttttttttattttccagaagatccttcaatgatattatttaaagtgtgttgtttaatttccaaatgtttggagattttccttttagttttttctcattgatttctaatttgattccattatgatcagagaacatacttggtataatgtctgttttttaaaacttattatgatgtgtttaatggcccaaaatatggtcttagggaatgtttcatgggaacttgagaccatgaaaagcaaaacaccatgctttttgctgttagttggaatatcctgtaatcaggtcaagctgattgatcatgttgttcaggtcatctacatccttactgatttttctgcctgcttgatctatggatctatcagttactgataaaggagtgttaaagtctcagctctaataatggaatagtctagttcttctttcagttctatccatttgcctcatgtattctgaatctctcttgttagatacatacacatttaagtttgctacgtcttcttggaaaaatgagctcctcattattatctaatgaccccctttattgcttccacttttccttgtggtgacgtctgcttcatatgaaattaatatacctattccaggtttcctttaatcaattttgcacaacacatcttttttctattcttttacttacaacctgactatgttgttatatttgaagcaagtttcttggggatagcatgtagttgagccatgattttatccactctgctggcctctgtcttttaaatagtatatttaagtaattacttgtattaaatgtaattaccgatatgtgatggtatatttaatgtaattactgatagggcttaagtatgccattttattttttgtgggttttttttcttgttcctgccttccagtggattgcattaatattttttaaaatccatttcaattttctaagtttgtttgtttgtttgcttgtttttacagtcttgctttgtcacccagtctggaatgcagtggcatgaaaatggttcactgcagcctcagcctcctgggcttaagtgatcctcccagctcagcctcctgaagagggaacacagatacatgctactatgcccgactatgtttttattattattatcattattattattattgctgttattatttagagacagggtcttgttatgttgcccaggctggtctcaaactcctgggctcaagtaattttcctatttcagcctcccaaactgctaagtatgattacaggtgtcagccaccgcacctagctctaaatatttttgaatgcattattgtgcagctctttttagttgatgataaaattatattcacacaacttattatagccttccggtgtaatcactttaccaatttgagtaaagtgaagtatggaaccctatgtctcttcatgttcctttactctccccaatttttaatgttttttagctaattcctctatgtacatttagaatcatatcagacgttgttacatttttttcttcaacaatcaaaacaatcaaaaaaattcagaaggatgggtgcagtggctcacacctgtaatctcagcactttgggggaccgaggtgggcagatcatttgaggtcaggagttcgagaccagcctgaccaacatggggaaaccccatctctactaaaaatacaaaaattagtcgagaagggggcacatgcctgtaatcccagctactcaggaggctgaggcaggagaatcacgtgaatccaggagacagaggttgcagtgagcggagatcgtgccactgcactccagcctgggcaacagagcaagactttgtctcaggaaaaaacaaaattttcagaaaatcagagaagataagtctattgtatttcttacatgtttgcttaccacgttttgttcttatctgatattccaaggttccttttcttatcgtttcccttttatttagaaaattccttttaatcattctgttagagttcgtcagctggtgacaaattctctcagttttccttcatctgagaatgttttcatttccccgttatgcctcaggaaaaatgtttgctgggcagaggattacggattgacagttctttcttttcagcaggaaaggaaaaattttgtggcactttcttctggcatccacggtttttctcatgagaacgctgctgtggtttgaatcatttttctcttctagttaatgtgtcatttttccctgactgctttcaagatgtttgttttgtggttgtctgcagttttcaaatgtttattaagtggcttggtatgcatttcgttgggcttatttatcctatttgggcttctctcagcttcttcaactgaaggtttatatctttgctatgcttgtgatgtttttaagccattatttcttcaagtactttttttttttaagttcagctttttattgaacacattataaaagaggtttcgtcaaaaagaccaaagcccatgtcaccatcagacttctcggattcttctttctttgcttccactttcttctcctcagctggagcagcagcagcagaggcgggcagaagctcctgctggtacagatagagccagctgctggaccaggtccaccagcccctacattgcagaggaggctccccatgttgactttggccaggcctttgcaaacaagccaggccaaaagggttcaacatttacaccggctgctttaatgagggcattgatcttattctccgtgacggtcacctcatcatcgtgcggaatgagggccaggtagatgcaggcgagctgggagacgaaggccatggcacgggtgagtgtggggctggcgctgccggacgcggatggaccgagcaccttggtggcagctgaggaaaggttcttcaagcacttttttagtccccttatctttttcctatcctttcataactccaatggcaccaatgttagatcttttgttataaacccacaaaagatctccatcccagaggccgtgctcctttttgtcagtctgttttctctccgctgttcagattaggtaatttctgttgttctgtcttctatttcactgacttagtggtttcttccatcttatcgattttgccattgagcccatccactgagttttcctttttgatgttgtccttttcagtcctaaagtttccatttttttataacttctatttctttgctgagaatttcagtttatttcctgaggccttctagtttgtaatatgcttaaagcatattattattattattattaaataatttttatcatagatcaggggtgtccaatcttttttggcttccctggccacactggaagaagaattacacataaaatacactaacactaatgatagctgatgagatttttaagaatcacaaaaaaaacaaccaacctcataatgtcttaagaaagtttacgaattgcttttgggccatattcaaagatgtcctgggccacaagttggacaagtttgtcatggatacttcaaaatctttgtaagctaatctattaactctgtcatctcaatcttgaccactattgatatatatattttttccatttagttagaggtcttcctggttcttggtacgatgagtattttgttgttgttgttgttaatacagcgtctcactctgtcacccaggctggagtgcagtggtgtgatcttgtctcagtgcaacatctacctcccaggctcaaatgattctcgtgtctcagcctaccaagtagctgggactacaagcatgtgccaccacgctcggctaattttttttttttcccagtagagacggggtttcgccatgtcggccaggctgttcccaaactcttggcctcaaacaatccacccacctcggcctatcaaagtgctgcgactacaggcgtgagccactgagcctggcctgatgaatgttttttaaaattgaaagctggacatctttgtattttgttatgcgattctgggttgtcgttggcttttgatgacaccactcctccggaagagggaaatgctgtttcatgaccacctgctgagggtagaaatttgacactgcagtgagggtggcctggtcaccactgtttgatggcagaagtctcgatgctcccttaggcttcttctgacaccactccagggtggagaagtggggtgttattactaccaggttggtgtgggatatccagtctcctctcgtgatcttcactgaaatgtggatgggggaaaggaggtctcattcctgacaagaagcagaccagtggtgactagggatggggcggggtgagggaaaatgaagaaaaatgggtttcaaaaaggcacaaggaaacttttggggagaataaaaatttctactattttgattatggctgtggttttagggatatattcatgtgtccaaatgcatcaaaattttatactttacagctatccaggttgtgtattaattatcccttaataggtataaaactcaaaacatctgaaaacaaagaaggaaatattttaagtctccttactcatgtcttcaatgtgaattaggttgtaagatggtaagactttctttttttcagcactgaatggtccagaactgtactgttcaatatgttagccactagccatatgtagctaattaattcctcatttatttcttttcttttcttttcttttcttttttttatacagagtctccctctgtcacctaggctggagtttaatggcgcaatctcagctcactgcaaacctctgcctcctgggtttaagtgattctcatgcctcagcctcccgagtagctgggattacaggtgcgtgccaccacacccagctaattttttttttttttttttttttagtagaaacagtgtttcaccatgttggccaggctggtctcgaactcctgacctcaggtgatccacctgcctcagccttccaaagtgttggggttacaggtgtgagccaccgtgcctgactagttcctcattttcactagctacacttcaagtgctcattacccacatgcagctagtgaccaccttactggacactgcagatatagaacccttacatcattaagaaactcttggacagcattggttcaggtattacaatattatgggaataattatctggatatgtgtgtgtgttcatgtgtgtgtgtgttttcataggctaatttttactttttcaaaatgaaattatgaatgtgaaagtgaatagtacaggacctaacacaatatagctatacaacaacaataaaaatgttagcatctcttccatccagtttggaaaatcttttatttgaaataagagtaagaagtcaattgagagaattccaaaaggtgccccaaagcaaaaacaaaagattgaggtttaaatgaactgtacggtataaaaaaggcaacaattttaaaagtaagatagtaaggataaatagtaaaatagtaaggctttctaattaagatacaaaacctagcagccataaaacaaatggctgataaatatgaattcacataaatttaaaaatttctatacagaaaagaagaaaaggcactataaacaaaataaaaataaataaataaatgactggtatacccagacaacaaaacatcattgagttctaaaaagaaatgaactaccaagccatgaggagtcatggcagaaccttaagtgcatattactaagtgaaagaagtcaatctgaaaaggccacacactgtatgactccaacaatgcgactttgtggaaaaggcaaaactatggagagagtaaaaagatcactggttgtcaggggtggaagagatgaacaggtagagcatagaggattgttagggcactgaaatgactctatatgatattccagtagtggattcttgtcattataacccatagaatgcacaacaccaatgataaaccctaatgtatactatggcccctgtgtgataatgatgaaccctgtgtgataatgacgcgtcagtgcgataatgatggcccctgtgcgataatgatgcatcagtggaggttcactgaaccgtaacaaatgtactactctggttgggacttgttggtagtggaaaagactgaggtatatgagagtaagaggtatacaggaaatctctttacctttctttcattttcctctgaacctaaaactcctctgaaaagcatagtcttaaaaaaataggcccggcgggatggctcatgctggtaatcccagcactttgggaggccgaggcgggtggatcacctgaggtcaggagtttcagaccagcctgaccaagatggtgaaaccccatctctactaaaaatgcaaaaaaaaaaattagccgagcttggtggctcatgcctataatcccagctacttgggaggctgaggcatgggaatggcttgaacccgggaggcgtaggttgcactgagccaagatcgagcctttgcactccagcctgggcagcaagagtgaaactctgtctcaaaaaaaaaaaaaaaatggtaccacactgtgaagacatttttgcaatcaactgaaaatggaaagtgtattcttccatgttgtctccccagcactcatcattttgctgtcacattttatatttactgatattagattttatgtatctttgttttaattgcccacttagacacagttcatgagagcagtgattttatttgtcttgcttatgcctgtatcttcagtgtccaaagtagtgcttggcatatgataagtggttggtgaatgaatggaaaaactttgagaaattgacaaagagaccagaaaaccaatagcaaagcaggcagaaatgtaaacaggatgttcacgtaaaagtcaaatacaaatgattcatattaaatgatgaataatctcattcatacttcaataaattctaattaaaacatatgaatacaagttttcactcaatacattcgtaacatgaaaacaaaaaatttataatacaccactttgaagaagagataggcagcaagagttttcatacacttgttagtttctttgtaggatacttttacaatacttataaatttatagttattacttttataactcagcacatgcactattttaaaaatttacactattggtatactcgcaaataaatgtgcacaaagatatatactcacacacatacacaaagatacttattttatcattgcttataatgacaacaaaaaaagtgctgtgccagccgggcgcagtggctcacgcctgtaatcccagcactttgggaggccaaggcaggcggatcatgagttcaggagatcaagaccatcctggctagcacagcgaaaccctgtctctactaaaaatacaaaaaattagccgggcgtcgtggcaggtgcctgtagtcccagctactcgggaggctgaggcaggagaatggcgtgaacccaggaggcagagcttgcagtgaaccgagatcgcgccactgcactccagcctgggtgacagagcgagactccgtctcaaaaaaaaaaaaaaaaaaaaaagtactgtgccaatacaatggatatcatgctattctgatgatgtgagcacttccctaagtgccaaccttactatcagaagaggacttggttgggaaggataatggaattccatcaagtgttttatcttcactaaggattttgagtttgcatcaaaacctaattactgcaaaaaagcatcaggacccatttccaaaccctcatgaaggggctctcccactcctgtatctgcctccagcaaagcactactgggatccactcaccagattatttatttatttattttttgagatggagtctcgctctgtcaccaggctggagtgcagtagcacaatctcggctcactgcaacctccgcctcctgggttcaagtgattctcctgcctcagcctcccaagtagctgggattacaggcatgtgccaccatgcccagccaattttgcatttttagtagaaacagggtttcaccatgttggtcaggctggtctcggcctcccaaagtgctaggattacaggcctgagccaccgtgcccggccactcacctgattattaaaccagattcatttaggactctgctgggcactgcgagggaataacataacagaagcatcatttctacccagaaggacttcaccgcctactaaggcaagctgtgtatagaggagaaagttaaatcattctgactactgcctttaatccaagactaaggcctgaaatcctgaagaatttacaaaatgcttagacctccattataaacttgcagttgccatccccagcctttcttactgctgcttggtaattcattttccaccaatttgttctctccttttgttcattccacaataatgagtatacatcgtgtaataatggggatactggcactgtggagagacatggtaaaaagaatggaggggtcactcttaagaaacctatttgaacagtatctgaagtgaggaaacagataaatagatcatataggcatgaaggaaaagcctctcctttgccctctgaaggttcattgaaaatcattgacaagaggcagattaataggagaaaaagcacacgaacttaatgtgtatatggaagccttctggatgaagacccaaagatatagaggaaattgtccatttttatgcttcgagtcaacaaagtctggaatatgactggacagaaagggaatgatctaatgctactagactgagtggggaagcccagcaacgcctgtccctctagattcttctggcctctctgagcagcattccttccttctgggtatggggcagagctctctctggactgggggtcttaggacctacagtccaacaaggcaggtcagataacttctttatgactacttttacggctggctttgaggagaaggggttctgatttccatgacccgcctcgggccagagggattctagtctctggggagaatggaacaggtcaggagaaggtcagagaaaaagtttgcttctgaggctgcttcagggtattgcattcttagtcccaacaattccaacgtggtaagtgctaggacagacttaagaacagccgcctacaggctcacatacatgaggtgcccaacacagactgagagagaaggaaagggaggaaacactcaggaacttgagtttatggtcagcttcctcccccattctttatggtgactgttccaatctttcaccatggttcaatttctcaatcacttctatgaagttgctcaaaacaaaagcaatatacagaagtttaactaaaaggtatagccctatttgacagagggataatttatacatacagttttgcacagattatatgcacagaattttagtccaaaacttgcaaagttctgacaaatgtatgcaccacgtcgattaaggtataaaacatttccattgtggtaaaaatttaaatgccctcctgatctttcacaccaagatcaccccatgccctgacaaaaaaaaactaggattctcatttctgtcaccacgttttagttttgcttttatgaaatgaaatctcacactatgcacttgctagcgtctggcttctttttatttactttttattttttgaaatggagtctcacactgtcgcccaggctggattgcagtggtgtgatctcggctcgctgcaactctgcctcccaggttcaagcaattctcctgcctcagcctcccgagtagctgggattacaggcatccatcaccacacccacctaattttttgtatttttagtagagatggggtttcacttacgttggccaggctggtctcaaactcctgacctcgtgatccacccgccttggcctcccaaagtgctgagattacaggcgtgagccaccgcgcccggccacgtctggcatcttttgctcaacatactgcttttgattgtcatccatgtcattacctgtattcgtgttccaagttgctgagtcacttccactgtatgaatctactacaatttgtatatagaccttcaaattttttccagtttatggctcttataaaaaatgctatgaacattcttgcacagagcttattgtagacatatattttcgtttattttggtaaatcccttccctctgcctttggtagacatataacgtagtattctgagtcttaaaagttagaaggttaggataaaaaaaaacccagtggtaaaactgtatcaataattctcaatctgatttttaagtggcctcagttataatcttcccttgtctctcacttcaattagaaaatgaaggttagcaaatattaatgccatcaatatacagcctccatacacatttatctgtctttatagctcctttctcctgttttctgttggactttgaggaaaaggtttctgttttcctgtccaaggcaaatccctcttcatcttattttctaccatctcctcaggagctttactgtactttgccctcaagtctttttcatattaaaaaaatgtctatatcaagctcgctagacaagaacatggcacacacagtctggcaaacaagaaatatatataaataatcctacaaacagttacataaagtgaaaagttctgtaaaggaaaactagagggaacaatgaaagattaaaacaacagatcctgatttagtttggaagctcaagagacttctctgaacacttggatagaaaacgttgaaactacagatgagagagaattataaataaggaaagtacttcaggagataggacagaattagaatcaaagtacagttgatgcttgaacaacacaggtttgaactacacgggttcccttataggtggactttcttccacctctgccacgaaagatagcaagaccaacccctcctcttcatcctcctcctcagcctactcaacctgaaaataataatgaagccctttatgatgatcagctcctacttaatgcataggaaatgcactttctctttcttcttcttcttcttattatttttgagatggagtcttgctctgttgttcaggctggagtgcagtggtgtgatcttggctcactgcaacccacgtttcctgggatcaagcgattctcctgtctcagcctcctgagtagttgggattatagacacatgccaccatgcccagctattttttgtatttttagtagagacagggtttcaccatgttggccaggccagtcttgaactcctgacctcaagtgatccacccatctcagcatcccaaagtgctgggattacaggtgtgagccactgcgcccagccttctttctttagattttcttaacactattttcttttctctagcttactttattataagaacacattatcgtaagaacacagtggtactttactaccacttcaagtatgttgaatgctcttttattcttggatatataataatagggcataatatatataatgtacaaatatatgttcatcaactatttatgttattagtaaagcttttggtcaacaataggtcattagtagttaagtttttggggaagtcaaaagttacagatgggtttttgactgcatgggagttggtgcccctaaactctacgttgctcaagactcaacggtgtaaggaatttgatttaggtagaaacagagtcaaaaccctttttctgagatagaaagaaagaatttgactagaaagtgaaatcagtttaaaagcgtggtatgagtatgtgtattccttatttttcctatgaaccagaaggcctgacaatcttttgagggagctgaggatgatacttgaaatttgaaggaagtggtgagaagttagaagtgctactataagaaatgagagaggctgctggcaaggaattagtaaaaggtttgctgagaggtcctgagggcccaggtgagggtggaaagcacctgtgattaaggcgctgcatcttgtacctgcaacacccaactgtgcgggcacatgcgcacagggacaacaggtggttttaaggtgtgtctggcaaaggccctggaggctattcaatgggaggaggaagtaagaaaattgttaaaagaatgaggacatttaaaagtcttgaagcgaaaataaagttaggcaaattctgccttttctgcctccacacctcaaatatacagatatgggacctgtatgcaaagatccgtccctactttatatggcaacaaaagacaaacaaacaaacaaacaaaacaaacaaaaaaacaataacaaaaactgtccttcaaaaaagaccaagtttcttttaaggccaaaaatctaaaaaaaaattctaaagagactgagcctgtaaaagagtttctatatatagcaaagattcagcaactgagataaaactctattttttctcctcttaaaaaaatggagatgccagaacattacctagacatgaacttctcacatttcaatgtgcgtataaatcacgttgttaaaatcttgttcagatgcagattctgattcagtaaacctgggttgggagcctgagattctgctttttaacaagctcccgggtaatgttgctgctgctggtcctcattgagtagcaaggatttagatcacctgaggagtgtaaatcaactctgagtgactcaatggggcttctgtgtttgaaaattgtaaaaataaataattcaaaaccaaagctgttgaaactgtaaatttttttcagccttaatggaatgtggccgtgtgcagaggctcacatctgtaaacccagcactttgggaggctgaggtgggcccatcacttgaggccaggaggtcgagaccagcatggtcaacatggtgaaacccatctctactaaaaatacaaaaattagctgggcatggtcgcacatgtttgtaatcccacctacttagtacgttgaggcaggagaattgcttgaacctgggaggcagaggttacagtgagccgagattgtaccattgcactccagcctgggcaacagagcaagactctgtctccaaaaaaaaaaaaaaaaaaaaaaaagaaatgtgattatgacattcagtcataagacagacagctataacctaggcagctgtaacctttgtttctctgattatagattggcctttactttacttacattgtttcgtaaaatgtaataaaggattaaagggcaccagagaagaccccttgcctcttcattgttggatcttcattatagattaacttcccttttacttcttttatacaaagacctcatgactatcacacagtctgaaacattaaatatacccttctaaactggaaaagggaaataaaacaagctgtaactaatcaaattgctgtaactcataaaccagccttgtatggaaaatattataatccggttaaatttctttgttttctgcctgtataagcaagaccttaacttttcagcttgggagcactgaccccattcctttggaatctgggttacttacatgaccattctcagctttgcacatgaataaacacttttaacctggattctgactctttcatttatttcaggttgacagaatgtaggaagagaatctggcagatctcagataaacagcaaaaggaagagagaaggtcctttgggtccctgtggtgaaggagtctatagtgacctgaattatgaaactgccccatagccttggaggttagagttcaaataggaggtaccattcagatttcccagccattactgagttgaaaactggtggcatcaactggcaccctgtagataaactgacacacgactgtaaacccagaaattggaagtgaacacttctctcactgttatacttgaatgggcatgttagaaggcatactgcaaattgttggaaggagagtcaacaatgagggacaaactagaaagtggaagaaataggtcagatgaaagttcaataacaaagcattaagttgagatggtatttggggtagtacctagtaagacgacttaagaaacatggatgaagctggaaaccatcattctcagtaaactatcacaaggacagaaaaccaaacaccgcatgttctcactcataggtgggagttgaacaatgagaacacatggacacagggaggggaacatcatacaccggggcctgtcagcgggtgtggggctgggggagggatggcattaggagaaacacctaatgtaaatgactagttgacgggtgcagaaaaccaacatggcatatgtatacctatgtaacaaacctgcacgttgtgcacatgtaccctacaacttaaagtataattaaaaaaaagaaaagaaacatggtatgactttctgggcttgtgtatctgaaggaaatggctctgaagtgatggctgtgctggtgctgtgaatgaacacctgatcatggtaccagtccacagtctggatgcttgtggtagagccaaagaattagaatttctctatggattgacgtttccaacataatacacatggatttaaacagttaaggcaaaagtgtttagcaacatatgctttcatgtcactaacctaaatccaccaggaaaaaaccccaagtggatcaagaactctgctctgtgatgatctctccctgacacattcagcacacagaaaggaatcattgctgatcgtttgtaacatgccaagaatgaaactgcattttgggatactttattttgctctcctccttagaggccaagagagaaattaaattaaagtccatagatcaaaagcataacttctcagctaaaaatgcagctacacattagttaacattcagaagaccaggccctttgcggttttgtgactttcaagttaatgtcttctcagccaatgcactaatttcctgctgatcctatcaatgggtcgcgtctgggaatcacagcacctacaatgtcaacagggagaatatgcagatgtctctggtggaagaggtgataagctccatcaaagtcttgatcctctcatcagaaaggctatcaccatttttcgtcccacatgggttttcccctctgtcaatatggccccgtgcctggtaaatctgcataatgagatggttttcataaatcacgtgcaatcaacacacagatttttttggacctctaaccaagactatatgtgttttaactagactgaatacataactctagtgaaataaaaagaaagtttgtctcaagcagagaaaagtcttcaaaagatggctgcaggagtatgcttccccagggagctaatctgtctgggttaggataagaaataaaatgattttgtttttcacatttttaaaaaagttcttgtggttgcaatatccaacaaaatgtactgttgactgcctcaaatggacagtgcatattcttccaggatgggcttggggactgaaaggcagaaggacatacgtgccccttccttcctggcagcaggggaggaaacggcctcatagaatggcagagagcaaagtagagcagcctcatgaaagaggccatggatgctgacatgcttgctggagaagatgaaagagatccagaaagttcctgtggccccttgagtgttagaaatgaaaaccaagtaaaaagtaagaattaagttgtctgctgggggctctccacagtgtggattgagggacctttagatgatggtgtcaaaggcattcgaaccagagtgactccatcttgagtaagggctagggaaaaaatgaggctgggacttgttgggctgtgttctcacaaagttaggtattcctagcctctaggtgcttactgttaagaaaacagattgataacatttactaaacagacccagacttaggagtgtcctgatatccccataccttgagaacagaagcattcttaattttgctttaaaggtaataatatcgattcttacaaaacatagtaattaagaaaattaatcctatatcacaaacccatgtagcacaacacatgatcttttgatatatatatatatctatctataaactagtattgtacctaaggtggatgcattcctccccttacttttggcaacgccctactctgtctatggagtagctgttctttattaataaagctgttctttcttaataaacttgcttttgctttgcgctgtggtcttgccctgaattctttcttatgtgagatccaagaaccctttcttggggtctggactgggacccctttctggtaacatcactagccagttatagacaacagtagtaatggggtggtgtggaggaagggagaccttacattgactatacccagagaacagaccgtgagctatatcaatgcaggaatattgaagagtgaatgcaaatagggcagagggcaacacgcagatacacaataggacatgacatctcaatgaagataggtgagaccggaggaccaaatgaggaccagaagccagggaaaagtccaaggtccctcatgcaaaggcacgagggcacacaacctacttgccttacaccagagtgctgtgcaagaaaaggaaggcagagggaaagtagatctgggaagaaactttccccagatgacagtaagtcaccagacagtggcaggataaccaggaagtgttcagttatacataataggcaagattaaaccacatttccaaaatctctcattatcccccttcctgacccttcatcagtcaataaaatagggctcatgaggacattcgggtcagttatacagtgaaggggaccaaaatatgtcacccaaatatacttctttggcatatttcaagatggctattccgaaaggctgcagacagaaatagtcttgcaaagctgccttttgtgctgcgagatttgcatctgtagagaaaatctacattggtgaaataaacacccaggctctctctgagtcccccttaaccagctctaggaaagattaactcacagtaaaaggagactaaaagtctgggacttttaaaggtctagcagagaaacttttaccactggctactaactgttctttctaatggctgggctgctacccgtgaggtttcatctgcataacaagatagcctttgcttgcaatgcattcctctctcactcttacataacctgtgatgctacctcctcccagaagccctaagcccctactcttctgtaacttcaggctggtataaaaatgtcagccatctgacccctcctttttttttttttttttttttttttgtgaaacggagtcccactctgttgcccaggctggaatgcagtggtgtgatctcggctcaccgcaacctccacctcccgggttcaagcgattctcgtgcctcagccttcccagtagctaggattacaggtgtgcaccaccatgctcaactaatatttgtattttttctagagatggggtttcaccctgttggccaggctggtcttgaactcctgaccccaagtgatctgcccaccttagcctcccaaagtgctgggattacaggcatgagccaccgcacctggccctgatccctgcttcgagtctcacactttgtgtatggctcctgtgtccacatgaatgttcacacatttgaatacctttttcttcctgtgactatgtcttttcttccaaaggtgtcccagctaagaacttgcgagggttaagaaaataaattatgtattttttctccccttcaacagaaataaaaagatgtaccctctgctagtgtcgtggtgttgttgtggtcaattttaaacaagctgcactagggatctgaaagggcccctcctccatttcatagctcagaaagcttgactgttgccttcactctgctggtgagaaaattagctcagcaaatatgtctcttcccactcaggcaaagcaaaaagaaatgacccctgtcaaggaatttaaaaagctgttacctaaaaggggcacaatgaggacattacctatctccattgtcttagtgttaggctacataattaaaatgactccaccatatcatgttcgtaaaagacataatgacaggaggggacagagcaaggtaatgtcgctcccaagagtcagcatattaatggggcctttcagtttgataatgtaattaaccttcttaaatcctactctcagtaaaattccaaggagcagaagctacaagaataatgtccttttcaagtaaccttactagcatcagggcattcacttgagaaatggtggtgatggtcaattcctgataaaagactttaaaacactgtttctaaaaaggtctgagctgccaaatatcagattcacatgaccaagcctatgttttcatcttcttctcttgatgaaaataatttctcctttctttcacaacctttcattttctacattttattgaatttgaagtcttgaaatgcaaagactagagagtcccatggtcgattctataaaatccaaatcatctccttcattggatgctttatgtctacaaccagccttcaatacataaaacatgagactgtccaacaaccaggtggcattggttagatagtatctctatgtatttacaatattattcttttatgcaatgttacttaaaggccaaattttaaacattaatagttcagacagcacttcaccagttttaaatccactggactgaggcactcaatgttacttgtctacaggtatctacagaactaaacttttgcaagctctctccagtcatttcgactgtggcccaatgatgtcacaggactgttgagacaacagaaatcactggatcagtcatgtaactaaccagtcattccctaaacatggaaactgctcaactcatttattatcatcctttgaatatgtattatgttccaggaagcaccatgatccttaccaagagggaagtaaaatatttccataaatatctacagttaaaagtttccatataagtggtagaaacaactatgaaaatcttgaggacgaatacatcattcctggatctggtgatcggaaaaggcatttcagctggccatgaagaataggttggtttccgtcagactgagagacgagactcttacatagagaaaaggattctccatcacttacatcaaaggaaaaatttttcatgggattgacaagtcatccagttcagcctagatacagggaaatagcgtgaggtaacactaaaaaagttgccaggtttcagaaaaccccttcagtctccagtgtgtttatgggcattgaatcacaaattgaaaaattctcccatttcatattcacaattaaggtacttctaaatctaaagttgcacagtttcaaaaagctttagttttcatctccaggctgtcaaagaaagtccaagatcttctaagataatcctttggaagctgagaaatagctataacttccaatgacagatttttattgtacccgaaatttcaagtttcattatgttcatctgtcgtgtactttctgggctaattgttctgctgtagcttagaacaaaaaatataatgcagaaactattcaataaaacctctcattttcacagttagggttcttaccattttttcttggttgctaatgttttcaatttggccatttgtttaaatttgcaatttgttagtaatttgcgtaacttaaacatctaatatataaacctttaacctattgaccattatagcttcatttcatagaagcatttataaacaaagtacatactagaagctgaatttgctcccccaaaagtttacagtcttgtgcattttagagtaaatgattggtcttgtactgattgatggtaacaaataaatgtcaacctcaattttgtattccaattttaacaaaattttggtacattgcttttaccattactatcaagtgaatttatgtaagttaatctaagaaatggcaatgatattttaggataatttcatttagatattttattcttttaaaaactaagtatattctctttccagtgatcaatataagataatatctattataagaatcaagtcagatcaaagtaaggcattgacttttttctgatctcccacattttagttgcctaaattgaatatttaccaagttctgtggcttgcactgcagaactgcactacattaagataactcccattaaacaaattcactttagtgtgtaatttaatcaagctatttgttcagtttgcaaccaggtcttaatttattgtttaattcagaggttactagaaaaatgctcacctaaaaataattaacctagaatctggcaaacttaccttataagaatattggcagaaatcctgtgtggggtgtgaggtacgatgggataacatggatgtgaaaaattatgaagatttggagcctgcctcacaccaaaccaggtttaaattccttagaaaaaattttacataaaaactcatgtctgggtgcggtggctcacgcctgtaatcctagcactttgggaggccaaggtggtctgattatgaggtcaagagaacaagaccatcctggccaacatcgtgagaccctgtctctactaaaaatacaaaaattagctgggtgtggcggcatgcacctgtagtctcagctatttgggaggctgaggcagaagaatcacttgaacccaggaggcggaggttgcagtgagccaagattgtgccactgcactctaacctggtgaaagagtgagactcaatctcaaaaaaacacaaaaaacaaaaatcaacaacaacaaaaaccaaccaaacaaacaaaaaaaaaaccccataacaacgtgagaacaaaagaaaacaagtaccagaaaagtgaccgtgtaatctatatcaatttagggagagacctgggactagagtactaatgtctctactgtaatacttctgtcatgtagcatttatcagagtctaaatttgaagtgggtttttttggagacagcatattgtggtctaattttttagtgcaatctgccaatctctacctttatgtggcatgcttatactattcacatttaaattgattattgctatattcagataaaaatctatcatctgtccacttgttttctactcattgcatttgttgtgcattttcctcttcttttactgccttccattgatttacctgagcattttatatgattctattttatctcctcttttggtgtataatttatgctgatttttataactttttaaggagttgccatagatcaacaatagatatttttaaatgatctaaatctatcctcaaataactctgtactcgtttattacaagtgcaggtacctaataacaaagacttcctaattcctcccttcccttgcagcattgctgtcattcagttcacccgatacattgctactactattgctttaaatgaagttatattttagattaattaagtggattgcttgaggttaggagtctgagaccagcctggtcaacacggtgaaaccccgtctctactaaaatacaaaaattagctgggcgtggtggcgcacgcctgtaattccagctaccagggaggctgaggcaggagaattgcttgaactcaggaggtggagttgcagtgagacaagatcacaccactgcactctagcctgggtgacagagcaacactctgtctcaaaaaaaaaaaaaaaaaaagtgagaaaaagaaaatatttaactttaccttcaattatgccttttttttatgttgcttctttgtgtatatacgagtttagtctttatttctctgtcacctttgaaacatgttagccagacatagaattataggttggcagatttttctttgaatacttcaaagatttttctccattctcttcttgattgcatagtttctggtgaaaagtcttctgtaattcttatggatgttcttctatagtttaagtgatttctatccccctctggttttctgcaagattttatccttttcttgatatgttatactgtagcttgaataggataagcctaaggtttttggttttgttttgctgttaatcctatttacccttttggtattttatgttgtctatttttttcatcagaggctttaacatggtaatcatagttattttaagtttcctgtctgttaattccaacatctgtttcatatgttagtcgggttctgatgactgctttgtctctctatttctttctttatttttttgaggtggagtctcactctgttgcccaggctggggtgcagtggcatgatctcagctcactgcaacttccatctctcaggttcaagtgattctcctaccttagcctctggagtagctgggattacaggcatgcaccaccatgcccagctaatttttttttttttttttttttttgtatttttagtagacacggtgttttatcacgtggccaggctggtctcaaactcctgactcaagtgatctgcccgcctcggcctaccaaagtgctggcattacaggcatgagccaccataccctgcctcgccttgtctctttagactgtgttttttcctcatgttttcgcatgccttgtaattttttgttgaaagccaggtatatcatatcaggtaaaagggactcaggtaaatatacctttagtatgagattacctttatttatctggctagcagttgggtcatgtctaatgtttgttgcagctatagataccagaggctttaaattcctctagtgtttgttttgtttttgtttttgtttctatttttttgtcttttttcttgatttgggggatattcttggtacaagtcttcaagaatgtgtcttgcaggtctttcagctgtaatacattgttactatactggaggcttattggtgtgacggtaaggtggagcggaggtggggggcattctataaacttctgcataagtctcatttagtgagactttttcttggggctgtggccttcacaggtgtttctgtccctccctcctcaaggggtagaggtttttcctctactttccctacttccattcatcgcttcagtgttctcaatccatttcctggatgtcatataccctgataattaggatttttcctttttctttaggtgagatatgctcaagtggggcagaattccacttcacaagctgggataaggtttcaaaattgccctcaggaaaatttattcccctggggactaggcctttgttaggcacaaagtataggacacattctctttcctttcccctgcgaaggccatgaggggatttttctcagagcctaaccatgaaaatctggtgctgtttttaaagggaaagcctacaatatgtgaggctatcccatgaccagggcccccaggagtgactcactctaatgctggtctgccctcagtttccagaaattcatcacatttactatttaaatgttcctgctaacttacggtgtctagcatcttcatttaaatgttcttactaacttatggtgtctagcatcttctgctccaagtaaacaattctttctgtactgtatctctctgaaggagtctgttgctgcagacttttttctttttttagaagaattataactttattttatttatttatttttttaaattatactttaagttctagggtacatgtgcgcaacatgcaggtttgttgcataggtatacatgtgccatgttggtttgctgcatccatcaacctgtcacctacattaggtatttctcctaatgctatccctcccccagctccccaccccgcaacaggccccagtgtgtgatggtcccctccctgtgtccatgtgttctcattgttcaactcccacttatgagtgaaaacatgcggtgtttggttttctgtccttgtgatagtttgctgagaatgatggtttccagcttcatccatgtccctgaaaaggacatgaactcatccttgttttatggctgcatactattctatggtatatatgtgccacattttctttatccagtctattattgatggacatttgggtcggttccaagtctttgctattgtgaatagtgccacaataaacatgcatgtgcatgtgtctatagtgttgctacagatttgaaaatgatatgttgacctatgacttcagttctctgatgggtagaagaaaagtcattgaattttggtttgtccagatttttcttgctgtaacaaagatttccaagtgatgacttaaaaagagtgatgacttcaaaagagtgatgacttctaagttctttgcatattggaaataaaagtggaagtctcagctcttctaatctgtgagaatgttagcaagttactaaatctctatgtgcattagtttttatcatctgaaaaaatgggtataagatgccttacctaatgaagttgctacaggggataacttctaaaaaacatctactgcaaagtctggtatgaagtaggggctcagtcagtgctatttgtctaataaaacacgcatgtattcatttcctagggctgtcataaaaattattgcaaacttggtggattaataaacaggagtttattctctcagaattctggagtctagtagtccaaaatcaagatgttgacagggtcatactcccttcaaaagctcttgggaataccctccttgccttttccagcttctagtggctgcagacattccctatggctacataactcccatctctgcctcagtcttcacatggctttctctgtcttctccttctaagatttatggcccacccagataatctaggaagatctcatcttgagatccttaacttaattccatctgcaaagatagaattttccaaataggtcacattcacaggttctcaaaattaggacatgaacatatttttttcttttttgagggaaagaccattcaatcttctataatgtattagttaagtcagctgttgactgaaccaaactatcagtttggccaaacaattaatcttaaagttccatataaacttctatattgccctagaagaatagagagtagtgttttaatttctttgtccaatagaatagattccacaatacaaccatcagtgccagacagtcaagaaaacatgatctactgtatcaacttactgtttttccttcaaggggatcacaatattttatccacaaaagcaatttgggatcattcctttgaatagagaggaagcaaataatatggttcttatgttgtaaatgggaaattaagacagaagggtaatccagttaatgtttatggtttaattaaaaatgctgacagaaagactcacgacattggtagaacttcttattagtgttgtcaacatagctgtactgcctcatcttcttattttctttctcaaatttcaatctccagaaccaaagaagctctattttgcatgcatcagtaacaatgagcaatttacacttagcgatcctcctctgtcacacaacagcagctgtctgtgagtcctcattctactgtgagaagcaggtttgctgttttattcctctcttattcagtgcatatgcaaggggtggggtggagggctgggtacagaggacagcaaggagacaataatttatcatttccaaacaaacaacaaaggttgtttcaaaaatccagcttactgtttttattttcagtctgtaattcattttcaaaatgtttggacataaccctttggctttgcttctgagcatttacatgacatttagacagtgaacacatctccgattggtgcacagctatgggcatatggcacagcttactggaaacacggattcacaagaatacgtatccagtttcagaataagaaccaagtatttgctgactgagtgtcatgtggactgttttaaactccctatccataactttcaaacctactctggggggcggtcaaggggaggaggtggaagggtagactgttggctggaatctaatgcctttcctttactattaaaaatctatgtgaaaacattcctaatgggtatggtaatataccactttcgtaccttataaaaacctatttacttagtttactcagtttacaagctgagatttgaagcactaaccactcggggtcctatcttgatagccctggcttacttaccaatataggagaatgtgttctgttcaacctgagaaaaatggtgggagaggaccagcagttgaacacctggcccatctaaagtgaggatggtaagaatgataaaggaaggtgaccagttgcctcctgggttctctgatcactgcatgtttagctgtgcggttaagacagcagatttaaacgcaatacagggtcctacgatgacaatattatctgccattgattgaaaactgattatatacaagggggttactattcaaaacctcattattccttataatagccctattaggtaggccttttcaatctcacatcatgtattaaaaccacctttgcaaaaattataactgataaaattattacagtgaaagaggtctgacctaaccaacttggtcttgcttttaacctccaagctgtccttgttcattcctgggtgtagagtgaactaactttgggagcaacgcagtttagagtttaactttgaaacataaaataacagtcctttcccgcaaccaaccctcttcttgcctttgttagactgcctttgcagtactaacaaattagccagaagactagaaattatagtttaggagtcactgttgtaaaacctgagattagtgtttgagatactttgcagagtctacattctaatgcaccagctgatgccacccagatctataaactgcctcatctggtcttatggcccccatccaggaactgactcagcgcaagaagacagctttgactccctatgatctcatctttgacctgtccaatcagcactcccgactttctgacaccctacccaccaaattatccttaaaaaccctgatccctgagttttcaggaaaattgattagaatattaactccatctccaacatggcgtggccagcatcgtgacacttaagctcttcctttactgtaatgccatggtcttagtgagctgattttgtttgtgcagtgggcaggaagaacccattgggtagttgcaatatgatcaaagtgaggcttaaaaggttaggtaacttgctggtggcctcactaaacctcactaactccatgctccctaccatggagataccactactaataattaataataactaataacaactattgttgttaaaatgatactgggtaaaatcatgtaaaataacaactatgagatatagttgttataatgattaaataggtaaaattgtgtagaataacaactacagatatagttgttatagttaaatgaataaaatcatgtaaaatttacaatcgtgtaaaataacaactatgagatatagttgtcataatgattaaatgggtaaaatcgtgtaaaatgctgaccaaaacagccttaacattttcctcagtttgactaaactttagttcagcttcttctggactcaggcccctgaactcccttgttttagagcgcttactttagaaaactcgtagatgtacattttctctctgctcctttaggtgtaaatctttttaaaagcctcttgccagttttgtaacccagcactgtccttctcaaggacctgagaaccattcctttgaaaagtcatcatcaatgaagacagtgcttcccagtctcccagggagggcacaggcttaaattgtcctagttgtaaaactacctcctgtcacaaagatatgagaaaattaactttgttttgggatcacgccaattggcaaacatggatgccctgtgatacgccccactccagttcttgaaactctaaaaactctaccatcctttattccttgagctctgtcttaattctgatttatcttccctaatgcaatagccttaaataacatcttccttgcctgtttacattgtcgagtgccatttttgtttttacaatgcttttcatattgattgattgattgattgattgatcaagatgtagtttcactcttgttgcccaggctgcagtgcaatggcgcgatcttggctcactgcaacctcagcctcctgggttcaagagattctcctgcctccacctcccgagtagttgggattacaggcatgcgccaccatgcccggctaattttgtatttttagtagagaggggtttctccatgttggtcaggttggtctcgaactcctgactcaggtgtggtcgacctcctgcctgccttggcctcccaaaattgttgggattacaggcatgagccaacacatccggctgacaatgctttttaataactgtttcaaagatgagaaaacagaagaacaaagaaataagctaatttatccaggactgtaacccaggccacctagctttggcggtcatgtctgaatcatcatacttcaaagggaaataatatattcacacagtgataaggaggcatgtgaagcctagcaccttcacttaacaggtgctcaaaagctggaagctgtgataatggagaggaaggaggaaaacaggactcaggacaagcagatctattttggatccaggcaatacctcttagtaatcctgtatccttgggagatcacagtaatagtacctgagatttgtgcttatgctatttccctgcagctgaatggaagtacaagtgttctcattgcctaggtgggttttgcacccactcttgattatccagcaggaagcacaaacatctttgaaggatgatgagctagtataccagtgacattctggaataatatctcattatattattattaagggcaagaaagaaatgtgaattgactcttttaaagacaatcaaatcaaatataaatgtcattaaatagacttaaggacgccgaatggaagaataaattatggagcagaaagtcaaggttagtcacagaaactaacaaacatagggagaacaaaggaaattgtggagagagatgtatattgatgctcaaaaagacactgcagatcattgatttgaaatgcttatgtattaatattaactggggataattcaggcctgttttgtattgtacccagattagaaaagcagatgtgattctcccacccctttatcaagaacgagagtaagtcaaagagattgctgattgcaaattaaaatgttaatttctatccattttaatttttgataaattcttattgagagctactaattttagaaactttcaagtaccgtaatagctttcagtctattgagtccctgggaatttgcctttggggccaattgctttctgcctccattatgaagaaatattaaatgctatcaggaagcgcaaaagccacccttggtagagagacaaatttcaatttatgaaaggcaaagtattttaggttatgtaatatgctctccagtgcaaacaaggagttgaggatactagctttcaaggaaagtacaaaatacacaatggtgttgaacaggacaggtcagtggttagcagaagtagtggcagcaacatcagtagaggggtagtgtggtaattagatagtgctatctaagctttactgaatgcttattaagttcttatcacagatccatgggctttatatgtattaggcattttaatccttacaaaaattattttagatattatcattatctctggtctacagccagggaatataaaacaaagagaagttcagtcatttgtccaaggtcacagagctgagaagctgagatctgaagccacattgtgaccaccacctccagattcaagctctaactacttggcatgcctactgcctaggggctgtgcagggagcttttcatattccacattgctgagaactgatgaaactaaatatgggggagggaagattgtctttttgctttatctatgcctcaagaaccacagagatgaaacatgtacaaaaatgggaaattctagaagctttttttttttaatgaaggatattacagttcataagaacaaagctatcacaggaatcattttcaatggattcagttacctgatgaaggtactgaagggaaatgcagaatccaaattatctaacagataattcacaaaatatgattgacagtggactcactttctggaagttagagcaggctggtgctaaactgaatcataatggaatgatatattccctcaggtgaaatacagtctaaatcttcatgctgttcgtgcagcacatagcattaatagaacatagtaatgtggacatactttctaaagcagcaatacaaatgtatattggcaaattgtctctttaatatattgtttaacttctccatagcactcaacacaatgtgtataattaactgagcaattatttatttagtgcctgcttccagcactggaatacaagctctgcatggtcagcaactacacatttttcttattatattttgccttcccagtgtctagtggtgtgcctcacacacagagggaactcggtaacatttgttgactgaataaatgtaaggtattttctacataatgcagacttgttaatttattctgctattaataatttattgccgggtgcggtgactcctgcctgtatttccagaactttgggaagccgaggcgggtggatcacctgaggtcaggggttagagaccagcctggtccaacatggtgaaaccctgtctctactaaaaatacaaaaattagccagacatggttgcacatgcctgtaattccagctactcgggaggctgaggcacaagaatcgcttgaacctgggaggcggacgttgcagtgagccgagatcgcgccactgcactccagtctgtgtgacagagtgagactctgtctcaaaaaaaaaaaaattattgagtgctgtttatctgccaggcactacactgggcactggacagctaacagtgagccaggcaggaagggccatgctctgggggtacttacattacagtaagagagagacacaaccttgagcaatgcataaataaaatcattctagatattgttaagtactgtgtgaaaatcaaagagtctggtgagtgagagggactacttggtgagcggggtttggggcatccaatgttaaactaagtgggcttagaggatctctctgagtgatcataagacatccatgatgtcttcaaaggaatcaaaggaaagggttttgtacgcgtaagaaatggtaagaggagaggtactgaggctagaatgagcttggcatgttttaagaaaaaacaaggttccagcctcagcaacataaaaagaccccatctctaccagaaattaaaaaaaaaaaaaaaaattagccaggcggggtggtacgtgcctgtagttccagatgctcaggaggctgaggcaggaagatcacttgagcccagaagttccagtctgcagttagctatgattatgtcattgtactccagcctgggtggcagaatgagaccctgtctcaaacaaatacaaaagaaaagaagaaaaaaaaaaagaaggttcatgtggagtgtggtggcagggagtggggagggaaactggaggagaaacttgggaagtgagcagagattctgtaataagatcctgtaataagatcctataataagaaagattcataataagaaattcgttttaattctaactgcagtaggaagttggtgagtgatcttaagtaggggaataatgtgatgtgatttgcatttttaaaagatgactttggctgctgtgtggagaatggcttgaggaagaagaatgaaagccaggagacccactgctgcccagggtgcgtggtatatgtactccaggggaaagatgctggtggcttagcctagcgtgatgaaaagggagatgagaatgagcctggttttgagattcttctagtgacagaaccaataggacttgatgatgggtgaagcgagggaaagagagacagatggaggagagcctaggtttgtatttttacaactgcatgagaggaggagccggcagttgagaaggagaagtatggaggaaaaacaggtggagagaatgggaatcaagaattgggttttgtggaacttaaatttgaaacacatattagataaccaagtagaaatgtctagtgtgtaggagaatatagaaatactgaagtaactagcatctagatggcatttgaagctacaggattatactacctgtgacaggaaatatgtgatttattaatttagtgcaagtgtaggctagctggctcgttttgaattaagatgagaggaaatagctttaccttgtggaaccactggagagaaacgtgtatcagctctatgagcatgattactgggcatcagccatgttgagtgctggacttcagaaaatgaagatcgggacagcagaggaccaagaagccagtgatgttcactaagcaggcaccagccttccctccctttcaacgtttggatgttgtagttacataaattcctggccacatagactcaaccatagagttctcaagaggatgccgatggatagagttttgaattggattgggaatccaaatcaaaagtacaagaaatctgcttgtgaattgaatttacctgacagtgtcaacattaagttgtctgctaggaaagagtttggaactcatattcagtttgtagaaatacatacaattatagcttgtgcctatccaaagctttactgttgcaatggtattatgcagtgagggaggacacagaggtagagacaagacgcacagtacacagccccaggccactgggttcacttcatcattagtttttgttggagaaagagactgagatgccggtgaaacagggaggaggagagccaggagagcacgggatgaaagaagcccatcaaagaacgtgtttcagctgaaagatgctgctgaagaggcaggcaagatgcaggcagagcaatggagatcagcgagggcccagggaggcgcagggactggagctgagggcacagacacccttaggataagttgaaaagcaaaggacaagtcgagacacaaaataatcagcaacaatattcttatgcttgagaggatcaccatctgggtagtgaggcaggatgagctacatcataatgacataaatcataaaaccgatgcgacgatgactaccaaggccacctgttgacacagaagacccaaagggaatgcgaactggggcagccagaaagggcttcaaaagatactgtgttcctatttcgaagaaactaagaataagatgaatggtgagaggaagaaaggatgttccagccaagagattggaccaacgtgggcaggcgggagaaatcaatacgattgaagaggcgaaaatcaaagggacaaagagatttctggaggctggctcggtagggttgtaggttgaggctgttgatgtaaaaaagaaaaacaaaacaaaaacagaaactagaggaagtcactctataaagcagaacaaatccaagaatttcctgacacaaaattaccatggggggagggggagggaagtagccatctagcaaaatacattacacccactttcttttagcttcaggcacagccaccaatacttattttcagcacccttttataaaaatttaaaaccccatgtaattatattcattcattttaaacataacccctcgaaatctagctttgtatttaaaaagaaaatctgacgtggggtttggaatcatggttatagatgaatttggtgacaagtcaaacattttggaaatgagtttccacacatctgctaaagaaccttttgttgccctttgagcagaatattctgggtgtagtgacatgtgcaaaataagaaatttaatatttttaagccttcaagatgaatgttacaacatctgaacaagaataaatgccatgcttattcaattaccttgcatcccagggtcttatttaccatcagctttctcagcatgccgatctatttactgctaaattgaataattccgcctaaaggagataacatactcttactgacagcttgtccctaaactcccagatttcacaacatcagtacacaaatatacaatatagaaatggttgcttatgtgcattagatctgatgtaaacaacagctgccaaaaagactgaattagcctgatcttatttcatttctcttcttatttcatttcttttcagtgatatttgcctttttaaaaataatcagttgtggcaatacgtgaagcggagaggcacagataacaggcacctccattacaccaatgacggttctgcagtttttcctaaagtctttctagaatgacgcacaacacattatagcttccgtgtttgctcaagattatttgattaaactattacactgagagtaaagattactctttttaggttgtcactttctcactgatgcttggcaatttacttaagggaataagctaggtgtaggtttgcaccccttgctctatcaagacaatggcaaatattgattggtagtaagtaaggcttagacgtggtttcctttttcttttacatcagccgtgggctgttgagatacaataggtgcagccaaaactgactgataaatatggatttctaccctcccacagggcttggaataatgattgagttgctttgttttttccagaacttatagcatatatatatatacatacacacatacatacacacacacactatatacacatatatttataaaatatataaatatatatgtgcaatatatatacacatatacaaacatatatgcatggtatgtatatagatgtacacacacacacacacacacacacacacacatccttctttgatggctccacttcccatccaattgctcaatcccaaatctggaattgccttgacctatctctcttttcctctgttactcaaagaaatcttaaaacttggctcattctcatctctcctgtcgaccattctagtctcagccactatcatctctcccctggactataccactgcaatctgggaaccagtgggtttcctggcttccattcttcctcctcaagcttttctctgtatagcagctgaagtaatcatttaaaaatactcctcttaaaaaaatcctccccacatggtattacacatggaaactgacagtccaaggctgtgatcaggcgatggtaggctcaactgggccagtccaagtgacatccctttgaaaggagcatagggagtgccctgccccaaaacaccccccaacacaaaacattcagcaacttcttttaaaaattatttgtataaatttagggagtacaagtgcagttttgttacatggatatattgcatagtggtgaagccccggcttttagtagaaccatcactcaaattaggtacattgtactcattaagtaatttctcatccttcactccccttcctgcttcctcccacccttccgagtcttcaatgtctatgaattctatagtcttgtcttcacactgttttgctcctacttacaagtgagaacatgtggcatttgacttcctatttctgagttatttcacttaagacaatggcctccagttccatctgtgctgctgtaaaagacattattttattatatatttttatggaccagtagtattctgttgtatatattatagtataccatattttctttctccagtcattccttgatagatgcttaggttgattacatatctttgctgttgtgaattgtgctgtgataaacatacaagtgcaggtatcgtttttatatagtgatttcttttcctttgggtagatgctcagtattgggattgctggatcaaatggtagttttattttttagtactttgaaaaatctccatactgttttccatagaagtactaatttgcatttccacccacattgtataaacgttcctttttctccacatcctcgccaacatctcttatttttttgactttttataatagccattcagactggtgtaagatgatatcttattgtggttttcatttgcatttatctgataattggtgatgtctagcattttttcacatgcttgttggccatttttatgtcttcttttgaaaaatgtctgtttgtgccctctgcccactttttaatggggttatttgttttctttgtcatcgttgattatttaagttcctcgtagattctagatattagtgctttgtcacatagtttgcaaatactttcttctattcttcaggctgtctgttcactctgttgattatctctttttctatgcagaagtttcttagtttaaatgaatctcatttgtccaaaatagtttttgttacttgtgcttttgaggtctcagtcatgaattctttgcctacggcaatatccagaagagttttccccaggtttacttctagtatttctatagtttcaggtcttacatttaagtctttaatctatcttgaagtgacttttgtatatggtgaaagatagagatccagtttcatcctcttgcatttggcaaccaaattttctagcaccatttattgaatagggtgtcctttctccagtgcataagtttgtcaacttagtctaagatcagttgactgcatgtatgtagctttatttctgggttctctactctgttccattgacctatgtgtctatttttataccagtaccgtgctgttttgattattgtatccttgcagtataatttgaaatcaggtaacagtgatgcctccagctttgttctttttgcttaggattaaatttggctatttgggttcttttttggttccatatgaattttagaattgttttttctaattctgtggaaaataatgttgggattttgataggaattgcattgaatctgtagattgctttgttaagtatggtcatttaaacaatattgattcttccgatctatgagcatgggatagtttttcatttgtttgtgtcatttacttgtgtcaatttctttcatcagtgttttgtaatttccctctcagagatctttcacgtccttcgttacatatattcctatttattttattttgtagttattgtaaatcagattgacttcttcatgggttctcaacttcatcattatttgtgtatacaaatgctactgatttttgcatgttgattttgtgttctgcaactttacttaattcattgatacaatcaaatagtcttttggaggagtctttaggattttataggtataagatcatattgtcagcaagcagagataatttgatttcctcttttccaatttggatgcgttttattttttttctcttgactgactgctctggctaggacttgcagtattgtattgatgaattcttcttacggaaaagtggaagttctgctatatcaaaaagaaaagggggctgggtgcggtagctcacgcctgcaaccccagcactttggaaggctggacagatcatttgaggtcaggagttcgagaccagcctggccaacatggtgaaaccccatctctactaaaaatacaaaaattaactgggcgtgatggtgcacacctgtggtcccacctacccaggaggctgaggcaggagaatctcttgaacccaggaggtggaggttgcagtgagccaagattgccccactgcactccagcctgggtgacagagcgagagtccatctaaaaaaaagctggctgggggagcgggggaggaaagttccataggcaaaaacaataagtctctattatatattcatgatgaaattctcattggtccaaaatgaaatgaaaaatataaaaatgatatattaaaatttttatacaattcattatgagtttttatattttatataaaaatgatattttgaaaatttttatgaggctaaatagggttaatttttaaatatttattttttactgccctttactattcttttttagttttggtgataaaatgtcctttcatttaatatgttatggtgatatcagtttacagttatctttttatgtctttacttggcaaagttaggttaacaactctatgacggtttcctaatatattgtttaaatttatttgttcacaatatccaaacctttgggaatccttaatctagagcacattttaccaaagtgccacctaaattgcagttggaattgcttgcaagaaagaagggtgggagaagtttactgtcgaatatactcaggatgctgagataagaaacttaaaaaaaaaaggaaccttaccacagaacttctcacagccttaaacatgctgatgtagatggtgaatccccaaaatgaagatacagtatacagcatatcccacaattatttgaccaaggaactcttgcacgaagaagcatcttagagacttgtcctggaaagtgttaatctagagactcacaaaatacttcaacaaatattgaatattggctggcaaatagaaatgcataatgacacttctatagaaagaggaatccaagggacataaaagaaattaagatgagaattcagagatttgtgccatgtcatcctcgactacagccttagtattttcaacttactggtttcttagcttggtctgcatatttgtgaaagaataagccccattcatacgcttatattttcccaaatgactttgaaatgtcaagccattgtatgaatttgaaacggcatctttagacctttactgaagttatgttactgttgccggagtaactaacaagtatcacagggcaggggaaggcagaaaaatatcctttcatttatcaagcactgaataaagcaagaggcttagaaatgtgcgatggaacacgatgttacaaagctattgttcctgtacctgtaaataaaaggtaacaaggtccatttgatgacaaagagtcatgagacagctacacagctcctcttcaaaaggaaacaataaaaacttttaaaaataccaaataacattacacttcttgctctaaaagtatgctggttatataacagaatgcaagtagatttataattagcacttgtttatagatgtcttatactgtgtcatgcatggaggggcaaaagaggttctgatggctattcattcagatagaagttatcgaggccataggaagtgagagcgccatcatactaatgttaaatagactgaacaatgggaaatttacaaccagcacaaggatgaatcagttgatgaatatcacattgttgatagaaaacgattttgagagagtggagcaaaacttatttaggaagttagaggcatctctcctattctcttcttccaaccctccacttcttctcgtatttaagattaatagataattagggtagaatggatgctctttaaaagagaaagcactgaacaggagagattgtgaaggttttttcatgctgtggactcaggatgcaagaggggctgtaactctcaggatacaatgagaagaggcatcatcctttctggggtaacatttggcagtatagagctagaatagcaacattaagggtagcaagattaacagcaagaatacagggatcagaaagtctgaagctcgaaaatgctctgaaatcaagtgaagtgatgtaaagggaatatctaagttcatttctataatttctaggccagatagtttgttaaaatatggaagaatgcagggatgcaaaatttctccaggtatataaacagcataaggaagtaaaaaaaaaatatagtactctgagataatttcaaggaaacatctataggaattcggagaagggaacatcatttctggttgggataattatgaaacatttcggaactgggatatagctcaaaatacactcaaaataattatgtggtgggctttctcgatgacatctctcagagtggctgagaattctaaggtgtgtcaaaattctgtactaaaatttatggccaaatcaacttatttgatcaccaatactgccattgccatcagcatcaccattaccaccccaacactgctatcaccatcattactaccaccacttccacccttatcagcaccactatcaccattatctccagcaccaccacctccatcaccatgaccatcattatcatcatcattacagctaacagttatcgaatgcttactgtatgcttaacaccattctaacccctttacatgaataagcaaatgtaagctttcttcaaaattccaggtgaaatgctattttctctggatatgccccacttcgttgaattatcttcccttcaatgaaattttctctttctctgtaaagttctttaatggaaaaatcactttccacattatactatagatgtaagttacttatttcccttctttaaggacagattatgcctgattccacttcaagcctctcaaagtacccagcccactccttactactaattgctcaataaacttatttgtgttaaggaacaaataaaaagataattcctacggatacaatatttttaagattgactctcattttggaatacaaacatgacattgtatacaaagcaagagtttagttaccttcatccatgtcaaactatgtctttaaaattcacagaaaataaaagaaagacaagttacacataaaccttatgtcagttgtgatgcaaaaatatcagatgatcatttacacattgaaagaaacacaagtatagaatagttgcattatcaaatatttctacaaaatattattgatttataacagattttattcataagtcctgccactgctggtataaaggcaaagaaatatcatgtaggaaatatttcggctgcagttgttggttgcttgctgtggtggtggttgttggccttagctacatttattacatccaaaatatagagcagcgccaagatctgtctaagtcccatgcttacacaattagcatgcttctcattctaaaaatacctttgtccagtgctgtttgagaaaccagcagagtttttctaataatcttgttaaattacatgataagtaatccattgcttcaccttacaaagggatagttaggaacaaggattagatggtttgcctaagtatgttgtagtagagactagctgaaactatcttcttggatgcataggctgcatatgcctagcttgccgtgcagttagatggggccacatgactgagtaccagccaatgtaaggtgaacagaaatgtttagtccttctctataaaaaacctccaaggtgtcaacctccagttatttttgcctgttgcactccactaacaagaatggtgattgtgggagctacatacttaagttgaaaggacccacaagatgaaaaaagcttgagcccctgagtcacaacctggaagagaactgactagggacataggtttaagactttatatgagtaagaaatatgcttctgtcataataaatcattatgatttgaggatttatctgttaaagtagctaaggtatattaactaacatggacattattatcttgaagtggaatgttgctctaataaaagccttcaataggcttagtcgttatggagtacacggctaggaaatacgtatcagaagctggtaagatagagatgtgttatttggagacaaaacatttgttaagtctatcatctgcaatacatgttcctacatgtattgaccaactaaatcttcaattagcctctaactctgggagaagtaggtagggaaagttagaatatctgtttgtatgcatatttataacagcataattcacaattgcaaaaatatggaaacaacctaaaatgcccatcaatcaacaaatggaggccgggcccagtggctcatgcctgtaatcccagcactttgggaggccgaggcgggcagatcacaaggtcaggagttcgagagcagcctgaccaacatggtgaaaccccatctctactaaaaatacaaaaaaattagccaggtgtggtggcaggcccttgcaatcccatctaattgggtggctgaggcaggagaatctcctgagcccaggacgtggaggttgcagtgagccgagatcacgccattgcacttcagcctgggcaatagagtgagactccatctcaaaaaaaaaaaaaaaagtggatacagaaaatgtggtatatgtacaccgtggaacactactcagccataaaacagaacgaaataatgacttttgcagcaaattggatggagtcagaggccattattttaagtgaagtaactcaagaatggaaaaccaaatattgtatgttctcacttataagtaagggctaagttatgagcacacaaaagcataagaataatacagtggactttggggacatgggaggaggtgggattgaaggataaaagacagcattttgggtacagtgtatactgctcaggtataatgggtataccaaaatctcagaaatcacaactaaagaacatattaatgtaataaaatgtaataaccacctgcttcccaaaaactattaaaatcttttttaaaaaaatcagtgtgtatttgttacagttggctgctgttggtatgttattgccataaaaatagataaacgaaaaataaagatgttcttaggaaagaattggctacttctctagctgagttagaagtgattggagatcaagccccttgtagggttagaaaatccagactgtttatatatatcaaatagcaaatagtatcttggagtaaaaagatatttcagttgaaagaaatgattcagccctgcaacaaagactcatttaaaaacgttaccttcccactcaagcttgtactttcacaaggccacaacatatccataattatgttgagaaagaagcactgggcaaaagaagcaatgaaagcagatttgacaagtatagttaatagaaagtttgggtataattgctgacatagggagctgactgaaagaacaaacatcagaaattcctaagttcttgagacaattatgctgtcagaaaatccctgagcctggattttgccaaagcagttgacttcttgaactctaagacaacacttaggtctgccaatttgtaccagcctgagaagtgggcaatgaacgtagggtagccagcctgatccactcatgcctgtgatcctagcactttgggaagccaaggtgggaggactgcttaagaccagcctgggcaatacagcgagaacctgtttctacaaaaataaaaaattagtagggcatgcatttgtagtcctagctacccagaaggctgaggcaggagaatcacttgagctcaggagtttaagggtgcagtgagctgtgatcgcaccattgcacttcagcctgggagacagagcaagatcctgttgaaaagaaatagaaagaaaaaaaagaaaaggaaaagaaaaaagaatgaaagtcaggcagctcgtcaaggagagaatgtaccacaatgcccacttccgatgttgtgaccacagagaaggacagacaaaagaatacatctgtgtgtgaagatctaatcaacagatttcccccatttctgaagttgacacattcaggacacctgcccagcaagaatctgtagttgcattggtccagggaatgctgtctgcctcccattcttcacttttcctaattggaatttattagtgtgcttaacctttctctactgtgggatcaaacactgggcatgaggtgtgggttgtgaggagagggtaactaactggtccttctgttcatagataaaccacaaggcgccatatctcgttctgacagatggctgcacatcactggaaggatcttattcgttgaatcagacacagaagcagaatgggatttggggttgtctttggcacatgggtggtttataggtgtgttctatgtgtgagaagaaaaatgaaacagatatatggaaaccagaaggtagatttagaagagattggtcagttgatcactgaactcatttcttttttttttttcccccttggcatgcagcaagacagaatttctcatgctccttcacagttagttgtgatgtacaaccgagtttcaacacttggaagtaagtgaaatgaaatgggctgctttctaggcctggataggaaaatcccctgcccacgattctccatgctctttccccatttagcttgatgcaaacaagccagagaccttgaaggctagctggtgacgatggcagagccataacatggaaggatgtttgatctatgaatcgccacttggagaaccgacttgctgttcaggaacacccgctttggaaattacatgttcaataaataaacctgtgttaagacactaagattcagggactttgctgttagagttgatgggattaccttaaccacacacccacaactggtttaatagaagattgaatgtaaaatgatttcaagtgcccaacggctgaatttcttaatatgctatcctaagtctcatcatgatgatacactaggaatgacagaaatcagtcatatggactctttaagacagtttttccctgcaggaaaactgtgaagagtatcacctgaggtggccacatctcctttagacccctctcagcctttcagcgttttctgtaaataaagtccattcttcagaaaactttcaactaaactttgatgagatagagccaccagaaaagaaaaatcatgtatgctgtaaccactagaccaaggttcttttccaaagaggtttgtcgattttgataaatgtacttctaaatatatttgacatacataggcatcgggtgtttaatgaacagctttttctgctaaacgtcattttttccaaggttctcttacaaggagcttgacatgtgtagatgattatgagaatatatgtagactcactttttacttttctttttatttatttatttatttacttatttatttatttatttaagactgagtttcgctcttgttgcccaggctggagtgcagtggcgcgatctcggctcactgcaacctctgcctcccaggttcaagtgattctcctgcctcagcctcccaagtagctgggattacaccatacccggctaattttgtatttttagtagagacagggttttaccatcttggccgtgctggtcttgaactcccaacctcaggtgatccgcccacctcggcctcccaaggtgctgggattacaggcgggagccactgcacccaggcttctttacttaaaaacaaacaaacaaacaaacgaaaagctttctattctcagaagtgttcttgccctggctattataaattttccctgttctatctaaccaacagaatgtattactcttccctgggaacatgcacgtgcaactccctctcatgtaaaaattgccatattatccaagaagagtgtgtacgggtgcataattcaattaaatatgtagttcagaagcaaaagtaaatataagattgtgctaaggttcatgaattcaaagtttaaatactgagactctcagaaaatgtaaaatgcttttaaatgtatatatttattctgattattaccttttgaaaatgaactgaaaaaagacctacttaggaaacagaaatacttctgagatattgataagcggcttattatttttattgcttcaatttttagttttatgaattactctccaccacaacatattactggaaagttaagttttactgcggtgatctttcactaaagtctaattcattctaatcatttcaaaattcagagtttggtgttccatatttttgtcttccttgtcagttcattttgtatattatttacttgataagctgaggcttgaaaaaaatactcgcaaaagcttgtctgtacttatggccctgggcaggagtacaggcactttctctcatgagtattttacataggaatgatccagagaagagatgtggccctgtctctaccttgacagtaagctccaaatgctgacatttgctgaagtaaaaattctccctgtctagtggcaaaggtgcccccattcctttgaccccaaaactcccacttcccccaatcttcccatgcagatgttgtctgcagaaatgaagccatcaggcatcagaccccaaagcagacttaggtcgcatttacacattttctatcacaagcaggataaagacagactcaagttacccattacatttaggacttggggctcttagcacccaggctcagggttttaactcaggacacttacaatgaactaactcagtactacctttggtagtactacctttgagaactaggttccctgctagactttgaatttcttgaggattgggggcacatcttatttgttgttgtgtccctggaacctaccaagtactagagcatcgtgggctggctgtaaatgtctgtgggatgacttagtaaatgaggaaggcgagacatccttgaccaaccatagtgactaagatactgcagtggaacacctgctgttcctagttaactaagtaaatatggatctcccatagtatatagagaaagaataactctaaggaagaaggggataatggctgcgattccttccaaaagaacgctgtcacatgtgtgggggcgctgtacatatgtatcatctcttaactacaatctatgcatgtagtttgtttacagagatatttcatgcatgctgtagaaaattcaggtcatataaaaagggattataataaagctaaaatcccctaaaagttcaccactcagaagaactctcccatcaacatttgtatggggatcacccaaggtcaatctttctgggtatgtctgtgtttatgcttcctataatttattttgatttatgtttttgctgtatcacttctgcttctcaccctttatgacatgatggagatatgtctcttttttattttactagtagtcacttttataactttaaatagcatattttaacaaagttcttaatatattaagtacagacataaaataatacatacagaaaaaaaggcacataaaagaccaggaatagcttactttctctcatcttcattttattggagcatgcttcaagattatgtcccttggccgggccgggcttggccgggcgtagtggctcacacctgtaatcccagcactttgggaggccagggcaggcagatcacctgtggtcaggagtttgagtctagcttggccaagatggtgaaaccgtgtctctactaaaaatacaaaaattagccgggcatggtagcacatgcctgtaatcccagctacttgggaggctgaggcaggagaatcttttgaacctgggaggcggaggttgcagtgagccgagatcacagtgagccgagattgcaccattgcactccagcctgggtgacaaagcgatactccgtctcaaaaaaaaaaaaaaaaggattatgtccctttatcctagtgtaattattattactttatattgtatggtatacttgctttcttttgtacagccaatatttccaatagatattgtgaataattgtttgctcaaatgactttaatctcattactagtccactcattctacacgagtttttgaaattattatcactttccagttcagtagggtatatctgatctatttcctgagtctttaaaatgttctgaatctttgaatatttattcatatatttctattttctttttatatgagctataacttaactggttatataatacttttgttacactattttgtctcaaattgtgtagctgttgcttcattgtctttgggacacaatgctgctaaggaaaaagtctggatccaggctaatttttttctctatgatattgttgaccctatattgttactttgtatttttgttatttgcatttttcgttgttgtgttcttattttttccccaatattttcaatctatggttggttgaaacccgctaatatggagggtcaactatgatatgatattaatacatatatagatatatcatatataatattatatagttatattttatatattatattagttatattttatatattataatattatatagttatattttatataatacatattataatacatagttatatttatataatattatgttatatctatatatagatatgagaaaaagcaaaaaacaagaacaattaaaaaatataaatacaaaaacccagtagagtataacaactatttatgtagtatttacattgtgttaggcattataagtaatctagagatgttttaatgtataagggaggatgtgtgtaggttatccacatatattatgccattttataaaaaggacttgagcatccacggatattggtatcgaccagggtcctagaaccaatcctgtgcagatactgagggatgatgtatattcttttgcatgtatgcttgtagaaatatttctaaatccttgcatttcaacaacctactacaatctttgtgctacttgctttgtgatacacatgcttagaacatcttgcctcatcttgatctgcagatttgggtttgaattaatttctttctttttgttttttttgttttttttttttttggtttgagatggagtcttactctgttgcccagggtggagtgcagtggcatgatctgggctcactgcaaccccgcctcctgggttcaagcgattcttgtgcctcagcctcccaaatagctgggattacaagtgcacacaaccacgcccgcctaatttttgtatttttagaaacggggtttcaccaaattggccaggctggtctcaaactcccgacctcaagtgatctgcccgccttggcctctcaaagtgttgggaatacaggcatgagctaccgtgccctgccctgaattcattcgtttgtttgtttggtttttaagacaaagtctcattttgtttccctggctggagtgcagtggcacaatcatagctcactgtaacctcaaattcctaggctcaggcaatcctcccatctcatccttttgagtaagtgagactacaggttatgccaccatgctcagctaattttaaaatttatttattttttttgtagagatagagtctcgctatattgctaaggttgatcttgaactactggcctcaagcagtcttcccacctcagccacccaaggttctgggagtacaggtggtaagccaccacacctgacttgtttctgttgttgttttgatattatcttcaggtataacaatgatccataagcttgatatttatttcgtgcctccatatctataatcttctcccttattaaataagttaacacaagaatttagagcaatgctttacacagaatatatgttcaaaatataaattattataactgattaattgttttaactcttttttccctaaactctggctgattttctcagtcttctccttcctatcactgactcagctctgtagtgctgattctgtacttcgagtttctaaagagcttttaatttccatgatggcaattactttctcttcagtttctttccttaatatggctagctgcccttaaagtgaattcacttaaattatcgtctcatctttgatctcttcattcagaacagtagatgatataccttaaattttattaaattcctccatgttggaaaacacttgtctaaaattttcttctaattccttgagtgtgctttcctccaaaatgtgttcctgaattaatcttctgcatgctagactttttttcttttaccctttggctaccttctcttttgcataaatttaacataggcaagatattttatgtctaggtgtctttgtatttacttacttatttatttatttatttttgagacagagtctcactgtgtcgcccaggctggagtgcagtggtgcgatcttggctcactgcaacctccgcctcccagattcaagagattctcctgcctcagcctctcaagtagctgggattacaggtgcccacaaccatgccaggctaatttttgtatttttagtggagacagggttttactatgttggccaggctggtcttgaattcctgatctcatgtgatcctcctgtctcagcctcccaaactgctgggattacaggcatgagccaccgcgcctggcctgtctaggtatcactgaacagtgaacgctattctacgcaggcttgccttttgcccaaacataaaatgggtggattctcattgcaactcctccttgttttcctgtaccttgcttgaaaaatctcatttgaaaaggaccaggaagtctccctgtggtttctattctctttaaagtatttcaagagagaggttttcagggaaggcaaaggggccctggagttctattcaggggattcctctcttctctcccctccatcagttggtctgaatccccagtaatatgggccagcttcacacaattgaaggtgtgccctggtctatggaaagtacctttggcatttagactttttttctctttggagtagggctgttatgcttcctgtgagatccttgtggtttatgagtttagggtttttttgtttgtttgttttgtttttcatatttcctaccaagcattttgttttctgctgagatttggggtagatccatttttcaaaaaatttcaactttatttcaggttcagtagtacatgtgcaggtttgttacgtgggtatattgcataacactgaggtttggggtacaaatgatcccatcaaccagggagtaaacacaatacctaatgggtagtttttcagccctgacccccccccccttttctagtcatccccaatgtctgttgttcccatctttatgtccatgtgtacttaatgtatagctcccacttccagaaaaccaaatactacatgttctcacttataactgagtagagccattgatcctcaaagatttgtctgtttccttagttagccaaaggggaaaagtggccaaacttttgatatcattcaagtgaaggccttgaaaaaccatttgtcttcagtggggaaaaagaactgcaagtgggttattctacatcttttcttcaacggccgacacctccattcttggtcttaacaaattttgaggataccagtcagcgatgatgagtatctgaatatatgtgactctctcatgggcaggaaaacaccctactaatctttgtacacttggtgcccaggtgctatgcatacagataaattctcccttaaagggtaatttgaatgccatatatatcatctgtagacagatgatttttctgcttgtccttagccacttaggttttgtctcttcttcttcaatctggcaatttcctatatatgaaatgtacaccagccagtagtgcaatttcaattcataaatgttacgttctactgcccatagatccccaaatgagctcatgaggaacttagagtgaagcgaaatgccagtggacctcctccaaaggcttgttcctccaacagcagcaaattttgtgagcagtccatgaaccccaagtctgagagatcagtctcagatctatctaattgcagggggctgtagagacttaaagcctgtatttattatcttaattaccttttggccagggcaaaaggagatgttatatagacaaccagttgctttgaggtttgcactgaatccacgtatctccgtagttgctcccaaccaatgatgaagcacagcccagtgactaaaatgggctatttctgggaaacataggatgctcccatggtgattttagcttcatagtttccccacagccttgctgaagttttcctggagctgtgcacaaatctaaaatacttgatccaactccctttcttttcctctttctttgtctttcccggcttcctggtatctttctttccctcccacctttcttctctctctcacttggggttagaactgaaggattacctgttaaacacgtttaaacatgcttttatgataatacagttcaaatgcttcccatatctacattataacctttattatactctctaatgtacttcagcattatgaaatacaacataacatacttcaacagggaacttgactttcaaatgtcactattagtacttactaaattgaaaggaaatgttctcctatcagcaagtaaacacgatacacttgaatattcatgccattgcaaccatgcactattcaaatcttctctgtcaaataattgtttacaatccttttttttttttttttttttttttgagatggactcttgctctgttgcccaggctggagtgcagtggcgtgatctcagctcactgcaacctccgcctcccaggttcaagcaattctcctgtctcagcccccctagtagctgggattacaagcgtgcaccaccacgcctggctaatttttgtatttttagtagagatggggtttcaccatgttagtcaggctgatcttgaactcctgacctcaggcaacccacctgccccagcctcccaaagtgctgggattataggagtgagccactgcacctggcctgtttacaattcttaattgcctgtcagtggtgtagatgtgtatgtatgtatggcggggtcacgggcattattaccaagtttaaaaggaaagagtctaaaaatagttcccatgactcaggaggaaagtgtccctgtgttgtcaccttatttccactttagatccgtctatgttcgtaaccctgggacaggatcaatgatctgtaaaccaggctcagcctccccctggtgagcctaatgaggcacagaaataaaatataaaagtaagttcaataccaaatcttataccctcctaagaaatagtaagagttggaaaaaataaatactcttttataaagagtgaaatgaatctgttttcttcatatctcccccacccctaacctttagtagaagccagcataaatctggggagagaagccctccatgagtgctgggccttccagcctctcacccacaggccatggtgtcactgtgactatagttttactaataatactatatggcggctcatttttctattcaaactctctggaagatattaaataagtctgttttatttaatagataaatcagggctgcgatgttctcaccaaccaattaagaagcccagggaaaatactgacactctccttctgaggttcctctgtgcctcctgaggatggcatatgtaaagttttctgtttccctggtcttttcatcccattcttatgcatcatatgagctttctagggttgtcatgacaatgtgccaccaactgggtggcttaaaacaacagacatttattgtctcatggttctggaagctacaggtctgagactgatgtgttaacgggaccacactgcctctgaaatctgcaagggcgatctccctgcctcttcctagattcattgggtttgctgacaattgttgacactcctcggcttgcagctgcggcacttcagtgtctcccttcattgtcacacagtgttctcccctcttctgtctgtgtcttcatctcctgtttgaataaggacacctagcttattgtattatgatccaccccggtgatctcatcttaacttcgttacatcttcaaagaccctatttccaagcaaggccacactcacaagtactagggggtagatctttaacatatcttttttggggaccagttcaacccataacactaagattgaaaacctggcaacatcgacttaaatatatttgagtgtgttagtgcaaacctggttttggtgccttttacattcaactggacattactggtgttatctcatacccctctttacagagttctgagttgtcttcgtgaattcttatttacaacatagatgcattagacacacacacaaaaactttattttgtttgaaaatccttgacctttggaatacatttaaagatgaaaagaactatgtagtcaactcaaatctctagagaccctgtagtcctcatccttttgttaaactttcctcatgactttgctacagtgggtagtcaggagaaagggctttcccctacctttaatcacaattgtctgtggacaacttttgtaatatatcccaatgttgtaggagtctcagcttgaccataaagaagatgctaatgggtatgttggacgaactgttggtgcagacccaccaggaactaagggatcttcctgtaagaagttcttgcaaggaaagatggaatttggcataatggacttctacagatatcaggctttggtcatgtaaaagctgaggagctgctgaacatctcaataagtttaatgtatctggtttgtctccaggcccttgggacagacgcatgaaatctgtggtagtcaggatgggtcacactgtactaacccaaaaaggttacagctattttataaacaccaagagatgcttgacaagacaataaaacatagaaagtactattatttgagtgccctcggtacttttctcacacctggccaagacctacactttgtagggccttttctagcttcctctagttatagccttctccagaggttaaaagttctacatagctaaggggctgtgtccaccaagcatctttgcccccaattctcgcacacactgttagaatccagaaatttccttccctaaagaacgtgatcccattatcaagaatctccaggtcccttccccaggttttttatcctgaagatagatggcacagccagtatgtgtagatcaggctcaaggggtgcctgaggggtggctattagtggggatggtgtgaatagagcttgggcatgcagactggagcatccatacacttatccaagaggctgctgggcacacaaggaaaatcctcaggtggaaagggaaacaggagtaggctagaggctggggttaggtactggaggctggctctcccaggtcactatgttccatcatgggacactgaggagtccaagaattccaaatatgaatgtggtctttcttgtaattatgaaggtaggcttgtcaaagagggaagatagtacatatattattgaacattttcttagcttgattcataactttgaagtacaagtgacccttgaaccacatgggtttgaactgcacaggtctgcttatccctggattttctcccacctctgccactcctgagacagcaacaccaacgcctcctcctcctctttctcttcctcctcctccacagcctactcaacatgaaaatgaaaaggattaaaactgttatgatgatccacttctacttaatggatagtaagtatatcttctcttccttatgactttcttaattttattttttctagtttactttattgggagaatatagtatatgatacatataacatataaaatacgtgtcaatcaaatgtttatatgattggtaaggcttctggtcaacagtaagttattagcagccaagcttttggggagtcaaaatttatttgcagatttttgatggtgagggagattggcacttctaacccccacattgttcaaaggtcaactgtaaaatcctaggttatgagggtctctacttgtactcttgccctacaaatgttaggggtgggtctgggtgcctgtccatcaaagtatatttccagaggccaggtgggagggaggcagtagctgcagatccaaggaagcacagagaaaaatagtagataagcagccaagatgagacagtggaagctcaatgaagttatgtcacttatctgtctgaaaccttaattctgccttgtcatggaaactggcatattcacaggttctggagataaggaaacagacattttggagggctgttattctctctgctacaggctttaatcacctgcaacttggttataaaaactcgtttagatgctttatcaggtagcagtgattcaaatgaattacactctgtagttaccttgaaaggaacccctgaaaaagggattgcagaagccaaccaatatagcaaagcacagacttcacgtcctagctttttgccttgacttctttatttggtcaaagaatctctctctctttctctctctccccgcaccccccaacccaccccatcactcctcttctcctctgcctttcctctccttctcttgcttaacaactgattcacactgtttaaataacttccgtgggtagagagaacttgaagtacaaaaactaaatagattttctaagtcacacaaaaaatctgagaaccaagatgcatgcatttgcttgcatcaacagataacggctaacttgcattgagtgtttctctgtctgagatactatactaagcacttgacatgtgttatcttattcactccttctaactgccttattcagtaggtgctataattattactatctcatttcacagatgaaaacactgaagcttgaagaggttaaagaacttgtccacaaccgtacacgtatcatgtggcgcagtcagtcctcaaacccagcctctatagttttgcactgagccccttcaccaccatgactgtatctaggaatccttgctaagcttccccagagatgtgaacaccttccataaacatgttatatacagcagacatgaccacagcttgttcaaatcagtagaacattttccaagagcctaacatgtattgggtcccgtgttcaatgctagggatacaaatataagtaacaaaatgcccatgcccttcagaacctcagcttcctggggaaaatggaaataggaaatgtcaacgcagcaagtgaagtgctatggtagaaggcattacagaagcccagcagaaggctgcaagcgatcaaggttgttaaggagaaaagaaacaggctaggaggggaggattaaaacatttgaggtggacgttaacagatgaatacaaataagccagatgaagagggtagggaaggtatttccagtcagggataagagcaacgtgaaggccgagcagtatgggaaggcacggcccatgcacagtgtcatgtacctatttacaccacacactactactctgaactctttgccataatacactctggaatgctgtatgccttagcttgaccttctctatttctataaaaagcgaaatcactcctccctctgatgacccatgtcaaggttgaaaaaccatctactgtatttcaaaattttctgagttgatttggccttaaggattctctaataagcctgatataattcttaacaattcccccccaaagtattgaactaatagctattccctgacgcaaagcaattttctcggaggaaatgatcttagaatttttctgcatagcgtggatgctttttttttttgacagaacactgatttctgaaaatgaatagaaagcagctgtatagctgagcttaaatgtagcccaatcatgtcatccgtgtgccagaacaagataatttttccaccctaattcccatcatcctctgcttgatttgaaagacacctacatatacttgactaagttctgggtgcttcaaaaatgtatactgtttcttcctaaaggaatatgaatttggaaggggaatcccttatcctaaagcaatcacactgaaaatatctcttgacatacatttagactttcaggaataaaatgaagattgatgtcacagtgaagtggttcaccagaatccagtaaaacttggggctaaggaaactttgcaatcaaaaaagcctatccagctcttcttgttcttagatgtccctcctcatttcttggccatgctaaacaaaatctcaactgttatctcaaatatctgaacagaggttattctgaacagacacccatgctgtagggcaagcaggcccttacaggccttgcactctttatcgtggccttgtagatctttgcttaatttgctttagtaaatattctaaatactgaccctcaaagtaggagacttttcctagagtttctcctgtggagggggaaagtcataaagctaattttggcaatttgaaaacaaaattttcatcactatcaacgaagaatatagcaaattttaataatatgacactgtgtcatttgaccacctgttaactctagatggcaaatatatttaaatgattctactttcatagatcttacttagcaataaggtgctcactattatcatcgtaagatttttggtgcaaaaagtatatactagacatctgatatggtttggctgtgtccccacccaaatctcatcttgaattgtagctcccgtaattcccacatgttgtgggagaagcccggtgggagataactgaatcaaggggggcagtttctcccaaactgttctcatggtagtgaataagtctcacaagatctgatgattttaaaaggggttttctttttgcttcgttctcattctttcttgtccgctaccatgtaagacatgtctttcaccttctgccgtgattgtgaggcctcctcagccatgtggaactagagtcccttaaacctctttttctttataaattatccagtctcgggtacgtctttatcagcagtgtaagaatgcactaatataacatctattcttctgtggtcagaagcgctctatgacctatgggtgtcacacccaataaatatgcatgaattaatggcctgacagtaataaaataagtagaatagagtccttgatctcactagatttatgatgaagttaaggaaagaacatataacactgagaattcataaacaaccccagaacagtattaaagacaactacgtgttaaactatgatagttcagcagaggagaagaccagtgtgcaacagaagagtcagagggagctacactgagagatggctttgtccaaaatgcaaatctcataacacagaaggcagccaaactcctgcgtacctccttcctcctcagacagactttaaatactttaaaggctggagtttcccagggtttgattctcatttctcttttcatctccatctccactgtctcctcaggtgatgttatccagctccatggagctcatagaatgaatgattctcagttaatgtcatggatactaatctcccatttgagcacctgatataaagatccaaccacttacttgacaactcaacttccatatgtaataggtaattcaaacgtataacatgtccaaaatagaacttttataccctacttcctgacctgctacttcctcaatcaaccacacatctattaagagtgccaatattcactcaggtgcttggaccaaatcccaagaatcaaccttgactcttctattttctttcttgcccatatctgatttgtcagcaaatccaatcatgtcttatcctttccactgtttccacctttgtataagccaacatcctctttctcctgaccaacaagtagagttatcttcctaaaacttatatcactactctacttaaaacactccagtggtcttccagtggtttttcaatgctaatggaataaaatccaaactttctaactatggtctgaaagaccccagtctagtaaatcaagaactattaatcatgcagtttggtaaatcatgacaacattaaaaaaatagagtggaataaaaatgccacagtgcaccatatgtagtaagggaaagtattttgtgatgctttttaattttaaatattaaggtataaaagataggaaaaaccaacaccactcaacacaggactactgacaccagattctccagcagacatcagttggatgtcctttcaattcggacactatctacccggtggtagcctcagatcccacaggttaacggctcagcccacaagactgcctcccaattctgatggtaatcacaagcatcaggttgtgacttgggcttctgactaatgggctataaattggagttcctacaacattcttcttaggtttgattaacttgctagcacagctcacagaattcagggaaacactttcacttatggtcattcattattataaaggatattacaaaggatacagatgaacagcctgaggtaagagatgcatagggtgacacagaattcagggaaacactttcacttatggtcatttattataaaggatattacaaaggatacagatgaacagcctgaggtaagagatgcatagggtgagacaggcaggaaggggcatggagcttccgtggcctccccaagcatgccaccatccagaaacctctgcatattcagctatccaggagctacccaatcattttggatttttatggaggcatcattacatgggcttgattgattacatcccccataagtggggagtggagatgaaagttctaactctttaattacttcttcagtttccctggaaaccagcccccatcctgaggctacccaggagcccccagccaccagtcatttcctttgcatacaaaaagacacttgtcactttggagattccaagagttttaggagctatgtgctagaaaacaagaggaatgccaaatgtatttatcttattataaatcaccatattaagttaggctatgtgtgtatttgtttgcaacacaaaacatttttcttaatatgagttacattcaaaaaatgtttgcaagcccctgacctgtatgatctggcccatgactacctctctgatcttttctaaaaccacactataccttgttcactgtgctacaacctcactaacattcactctagccctcaggcaggcaagctcacccctgcctcaggacctttgcatacattattctctctacttggaataatttatccttagacattttgtatgtatgcttctttcttaccattcatatctcaattcaagtattacctcctgctaggcatcttatctctaaagtaacaccttccgtactgttcatctcaccacagctatcttatcaccctgtttcagcttcttcttagcactgtacccatctcatctcattcatttacgtttttgtgtgtgcctttattttctacgtatttctcttagaatgtaaacctccacgagttcagggaccacatttctctggtttactactctatctttagtgcaaagaataatgtttatcacacaacaggtgctcagtaagtatttgttgaatgaataaagaaaactgaagacataattcccctctgttaaggtataatgggaaacctttggtctctcctgggcttctcagggccccgtgtagaaaagtcaaggctgtagaattagtattcaaaactcctccctttggctttgtgttcagtccaagagaccattcatttcagcacattaaactgttaattatggagtctggcttctcctttctttatgtggaaagaataaatagttattactaaatagtcatttaataggcagtggtttctttcagggcaaccattattaaaattgcacaaacatgtacataaataaagccatttacttaaaattaggacagactgacttaatggattccacttttcttactgtcctgggtactacctgcttggaatacacagtccttttttgtccttcctctcactttatttcctagctcttgccaatatgtacaccgttgatatatgactatttattcatggtaatttatttccaagactttttttttttctggggttactgatttagttaatagtatttaaaacacaaagtaattttttttggctggggagagatagccaaattgataattttatattatgtatgtcgtatgagtatggctttccctgaattttcactgcagatagacagacagaacattggtaagaaataggaacaccagactagaagtcagttatttaacgttccagtcccacctctcaccttaaccagctgaaatatttggataagtcatttaaattccctgagccttgggtttctcatttgtacaataagagggccagtttaggctttaaaaattcctgttatgtattcagacttattacattcaaagaactattataaattatcagttaatctttgcaaaaaacttacaaagtcggtactattatttctcctattttacatatgaggagaatgaggcagagagaataaataatacacattttaagtggtggagatggtttgaatctaggtagtctaaagccagaattcaaactcttattcttcttactgtaggatctctgttcctatttatctctgagagttaaatttatagctgggcatggtggctcatgtctgtaatcccagcactttgggaggccgaggtgggtggatcccttgaggtcaggagttcgagaccagcctaatatggtgaaaccccgtctctactaaaaatacaaagaaattagctaggcacagtggcatgcgcctgtagtcccagctacagtgagccgggatcacaccgctgcactccagcctgggcgacaaagcgagactctatctcaaaaatagtaataataatttaaaaaagagttaaatttataggttgtgaatccttggatctcatgttgttatagtaggtagatagtcaggcatgagtaggggaggtgaggcttcccctcatcccactaggaatgtcaggcaaccatcaggtgatggtcatgcagttgtcacgctgcctctctaaaataataattggtcgcagccagcaccaggaaaggcaggttccatatagatagaaaaagcacctgaaactggttatcatcagtctcctgatgagatctcaggatttgggcaaatgggctcaaacatgtgcattaagaggcaaaatggcagagtttcactggtatgtccatctgggggcgttccaccagtaaagggaagaatgagtcaggtgagcataagtacaactctagtaaacacactgcccatgctcacctcccaagtgctagcaggccattgtgtatgtgcgcagctcaccccaagggaagaagcaagggaaaagggatgtaagacaccagaaacatgccagcatagaaaaccctaagtccaaggtcaaatagggcacttgtcctctgagatgccctcttggccctcttccaagggtactttgctttctttgaattcatttgctttatttgaattctttcttctgaagagggaagaatcgaggttgctgaaaacccgtaaggattcacagccggtaacttgggtacccgccacagctaacatattttgttgccatgtgactccaataacttcaacctatagcaatgttagcttgtctgtatcttatttcaccagcaggctggaaactacttaagtgtaaagacgatgttcatctttgaataacctgagacaattagctccaggccttgcatgcagtaggcattcaatatttacttttaaaatgatgaggagttgggatggattcatgcaacaattttgacattaaccaggtgaaatctaaggtcctttctgagagtgtgtgattcaggcattgactgaatactcttcttgaaggagttggctgtgtctgcacagattcacctctgatttgctcctcaacttaatgcaatctggttttcagccccactgatgccactgaatctctgcttgccaaagtcaacaacacacttcgaaaggcatttcttgtcctaacctattgcatctcctgagaacatctaatattgttaactatcccctcttccttaaagcgctcatttcccttgaactggataacacagtgctgctgacttctctccatccacctctcagggtgctatgctttgtcttcattttaggatctgctttccttacctagatctacaatgttgggatctcccaagggtctgtcactggtccttctcttctcgctttccacactatactccttgggctttcccacacatatgctaaggatttttgaatctatagctccagcccagatctttctgttgagcttcagacttggtatagtggtaaaaagtgataacttactttaaaatacttccatatgaacagtatatatatgtagagtatattagtcagcatttgaaatatctaaatctggaatccacactctaggaatggataggaatttgcagtacctaatcagggatccatattcagagatggcttcaaaactgcttcatactgtgttaatagtctctcccagaaggccaaattagacagcaattttagacataatttttcgtttgtggatgagtgatacatgaactatatgtttggctataggaagggggtgtaaagacccaggaagcccagcagcctatgcctttgaagcaccactcagcgcctggcttcctgattctgtgtctctctcttcacaaagaactctgctacctgtggttgattggtcccaccacacgcaaagctcaaggctcactgtatcttgaacatctattggatagcaccttacacatcaagttcaacaggtccaaaatggaactgatcctctttgcacaaaattgatcctccttctatgttcttttatacagtaaatggatctacactcactcaatgggccaagccagaaatctggacattagtcttaacttctcccattctcatcatatccacagtcagtcaattaccaaattccatcaacatcatcacctaagtcattctcaaattcacccatttctctcccactccacaggcacctcccaaacctagggcaccagttcctctctcctgtccccagctggaccccttctactctattctttatacatcagccagagtgactcaggaaatggaaatctgtagtttaattaatatattgtagttacttataggaaaaaaaaggctgatagagaaaatatctaacaactattaaatagtataggtagcaacaagtcaaaagaaatgccaaaccacttacagtgaaaaatagttagaaaacaacacgttaaacaagccaggttattgctgcaattatcctaactttgttatgttgtagattgggcatatcactgttaacctttgtttcctctatgccaagtaatgcttgacagacagcaggctcttactgaaaaaaatgaaagaacatgaatgggaaaacattcaatcaatcaaccttttttttctccccccaacttccactcccagttttcctcttaaggaaggagtatgcctcaaaccaagaaactgagaagtttccctaaatcctattgattggtaccctggacttggaagcaactgacttcttgattttctaccagggtttagttaactccacatagtatactctatgagacgtatcattgctataaggttaatgatagttatagggcccagtcaaacatctcacagggcctatattctgtgtcacttagcagtatgatgcatcttggcccagggatttgcaaccttggcctgggaatttccaggagacaagactacctcagcacagatgcagttctcataaaccttaaaacaaagcttagcgttacaagaatagcttaaactccctttgtgaaagaaacaccttgtaactgacccagaaggaatacaggtataaggaaaggggaagaatccccaaaactctaagaatggtctctggatggaaactctcctggtcaatgggtcacctgcccctcaggctgtgccaggcccatgccaccacctgctcccgctacctgtcttttaagggttctgccagaataaactgcgtgagcatcagatgctgcctaagactcagctttgatgggaatcaaaccaatggaaagaagtttcccctagaaaagctggttacctagagtcacccaagacccccaagactgacagtccagctcaacaaatgttcattgacaatctttagcaattataatgatgaatgagtcataccctctttctcttgtaaaggtcactgtattttggtggaaataaacatgcgtttgagtcatttaagtaaataaatgttgaagctgtgttatccaacaggcagagtaaactcatatttaggatatcagcatagcaggacactgaggacatcaagaaaaatttagaagagttcgacagaattgatataaaaaaccaaagcaatcaccaatggacaagttcagagctttacgatctccttacccttatgttataatttaatatgatttttattatgtggggttacacaatagtttggtctccccaataaaagggacctcttaaatcttaatctattcctaataagtgctaaaatagatacataaatagggtgcttgggagcacgcaggaggacaattaaataggctaaggcaggggagagtagggaacaggcgaggagaaggcagcgtcaaaaggagggatgcctgagctaagtctaaaggggcaaattaaccaggtgaaggtttgggaagctaggagaggtatactgttcctctggtgggacccactcacccctctgagctagacctcccaatacttcctgctagcctagaccatcatctgttagctccctattatctattacatctgccccattgaaccttgactctgtgaaattctgagtctgtacctcccaagaggtctacctagctgcaagctccatgcttggtcgtatctcaacactcaagaatcacaacatatttattccattccaataaggctaatttgctcatggtttctatttttgtttttccttcagtgatcacctacacttctgttagtcattaaacaaatggcagctggcatcatcgccaactttcaaaaccttattcaaaagtgatcttctataggaaatctttcgagtggttagatacccacatggaaagggcttccttctcatgaaaagcaaccaatgcactttgtttagcattgtgtattcataaatatttatccattaaaaacaggcatctgtatggcaagtcccacaaggatgatttaaccaagactgcaaactcctcagctgaccacatcccatctctctttgcttcacatcatcctgctagcccctcaaatgcttggccggccaacaaccatactgtacagtcaaaaagattcatcaagtcctcacttagtttttattcaaccttattccatcacaatttctcaccaacatcagattaccggtgaaaatttgatcagagagactgaggtaagagagactcaaattatttaaatctctcaatggaagttaatagttttgaagaattagagcatttcatatgggagcaatgtcaaaataggtgacctagaactgaagtagttttccccagactctgcagttactgaattgactccccaggctgctcatattttccggctatttctgaaaagaaaaatatacaaatgcaatacccctttttttccccaaaggtctttgcttccctataaatactaaagtgtgctccttaacccacttatcctgtgagatgcctaaaaatggcctcttggatgaaataacttcaggaaacaccgtagagtatagccctggtttgaaaattcactatgaacactaacgtgttaaagaccctattacttctgtaaatagcctagttttacttcgttaactcttcctttcacaagtgtatttgggcacagatcaagtttccccttcccgcaatattatcaacaccactccatacaaaggagagttggaaacagccatgttactcctccactgaattcacacacacacggatataagtcttgtgtagtctgaggtgttcatttcaaccctggatagtaattcaaagtagcaaacagctttttgatgtttgctttgtttggttgcagaaaataagctcagggtagacagttcttcaatgacagttctttacttgcataaagctagtatggattatcccaacttttataatgacagtagttaccactgggatgcaaaagaagcaaaaagaaaaataggagttctaaggggcaggagtattagcattgcactataatgctgcagtctaagcaggcattccattactgggtcgatggtgaatacgaagtggaggttcaatcactacacacacttactcaatagtctcctctaaaaaaggcagtaaatgtcttgtttttggctcagatgaaggcctatcaaccgtcagaagtgcaggcttccacacagagattcagagcagcactacagccgctcagcatgtgaatcccaagaggcaggtgatttagtcaataggccccagagcagctattttaaacacagggcctgttctctttaaaggtacaggatttatttatttgtgggccatttaaaatttcctgctttcaccggcttttgatctggactcaggtattatatcttgtcctattttccaacatgtaacaattccttacaattataatattcacccatccatccatttggctaacattattgacaacctattatgtaccaagcactgctctgttttttttttattgcatgtaaaaatgatggtgatattataatgaatgaaataagcatttgtttttgcaatccaagtaaaatttacctgtattgaagaatgtagaggatcttgtcaggaaactaacgacactgccacatgaaggaaatcaaataaagccgggcgcggtggctcacgcctgtaatcccagcactttgggaggccaaggtgggcggatcacctgaggctgggagttcgagaccagtctgaccaacatggagaaaccccctctctactaaaaatacaaaattagccgggcatggtggcacatgcctgtaatcccagctacgagggaggctgaggcaggagaatcgcttgaacctgggaggtggaggttgtggtgagccaagatcatgccattgcactccagcctgggcaacaagagtgaaactcagtttcaaaaaaaaaaaaaaaaaaaaaatcaaataagagaaaggtgctgtgctttttgtaggtcagtgtttttcacaagacaccgatattgaaatccctggaagtacctatttaaaatgcagattctgctgggtgtggcagctcccatcggtaatcccagcactttgggaggccgaggtgggaggattgcttgagcccaggaattggagaacagcctgggcaagatagagagacccagtctctaccaaaaaaaaaaaaaaaaaaatcagccaggcatgctcacacctgcagtcccagctacacaggaggttgaagtgggaggatctgcttgagccagggaggtcaaggctgtagtggttgcaccactgcattcatacctggcaacagagcaagaccctgactcaaaaacaacaacaacaaaaaataccaaacatttggccaggtgaggtggctcatgcctgtaatcccagcactttgggaggccaaggcagtaggatggcttgaacccagaagttccagaccagtcgggcaacataagacctcatttaaaaaaaaaagagacaaagaaagaaaaaaaagtcagaatccaggaatctggatttttagcagtactctggatgttctttgtgcatccgtagtgccatatccatccctgtcatgaaggaggagaaaagaggcacacattctctccaatagaaacacctccacattcatgtcttttatttattgggtttcctgtatgacgtcttcaaaaaaaaaggatgcaagaaaaatatcacttcttttaagtgtagcacattagaaagtcacacctatgagactctttagctgcctcatcattgtattttaaatgtggcctcacagagaaaccatggattttagaatcgggaagatacacctccaccacttattagttatgtaaatttaacaagctaatttgtctgtgtgagtcttgattttctcagctataaaatggggacaatagcaaaaaataatgataagataatcagattaaaagatatatcatagagatatatatatattatcttttaatatatattaaaagatatattaaaagatatatctgtaatagagatattacagatatattatagatatagatataatagatatatgacagatatattatagacaaacacctggcaaatgagtgggcttacactgggtactccccaaaatttacccccaccccttccaaattctgccaaattttatagagtagctatataaaaattatttttatgtgttttcttaaatgctcttcttaagacattggcccttatgttgtaggaaacacctcgatgccaggttgaagttcaatacttacgttaacacattatctttctattttatatcaatgggagttatttaaaccaccatatttcttttcagcttaaattatcagaaaatttagatgtgaaattaatgctcaaaataaaaaagtgtttctcctctctatattacttatggttattcttaaaaacaaatcacccatttacttattcaacaaatcattttggccatccaataaatttattgagagggtatatcctcaagaggaagagctaagtcttatgcctgcatgtaatacactttatttattaactgagtgatgatggacaagctatttcttagcctcaaactcctcaaatgttaaattaggctaataatagtatctcgcaagattgttgcggggattacataaatcatgtacttagaacaatacctggcatttggcatgcactatagcaatgttatttagtattatttaccaaagaatagttactgaagatacacagtaaaaaagcatcttaaaaaggtaaaaagagtatataaacttacctaagtggaagttaagtgtagcataaagtatatcttataaatgaataatggagtaaatgaaattcttattcatctcatctaatgcaagaaaactcaactaccaacattatggaattttgatttgatatcactcctaactctattttcactctccctgaaggtgttcctcattttccctccttgagtctgtctatatgcaagaatggatgagcaatcagaaatgtgtgctcactgatatgtggatatagacctctgaagcatctaccccattctaagatggtccctgctcaaagggatcatgctgaagaaaggtgacccttccagctcaggtttgctctgatctccgtagcataagcaacacaaataaagaaactatagtcataggactttcgttaaatgcttagttgaagatctcaatttctgtttgcttctccttagccatattccaagttcattaccattaaaaataaaacaacatgtaatcttaatatatacaattagcaacactgtgtgctcaacgtgtctttcttaagttcttgcagacttctttcttttctcctaagaaaccccatctctttagatgagcccaactattcacactctttcctctcgctcctcaaattataatcaccgtcacatcaaagacccactaaaaggcactcactgaagcttttaaattaaggtacttgaatgacttagaaataggaatcacaaaacaaatctatttacatgcatttgtgcagaacattcctaaatgttcaggtgacactgacctactaggccctttagctcgctatgtgaggaaataagatagaatcttcaaagaagtttggttgtcaagaagcctctgggaccagtgaaacaaataattaacttatagtggaaagagaggacaagaaatgtttccctctgggcctgaaatacagtgtgctctactttgcataagttaacatcgggaggtttgaattttccaaagggcttagtggctaattagctgtgtgaagttgcccatagtgtgtccttaagactaaacattcccatttctcataaaaagctgtaatagttacatgaagcaaaagaaattatctctactatgtgtttggggtttgtctttcttgtggcctcctttttacttctattacaacacttacgacacagtactatgaagatcaactctctcttccccactacaatggaagctttcgaagtataaggattgtgtctgacttaactctgtattccatgctcctagcttgacatttagtaggctctgtattccatgctcctagcctgacatttagtaggctctgtattccatgatcctagcttgacatgtagtaggcattcaatcaataatcagtgtttttcagataagtgggctagtatgaagaccaccgagagctatccttccagggctttaaacacctctatactcagctagtagaacattcaagtaaaatacagaaacctactgaataatgagatttttttttttttgagatggagtctcaatctgttgcccaggctggaatgcactggcacgatctcggctcactgcaacctctgcctcccgtgttccagtgattctcctgcctcagcctcctgactagctgggactacaggtgtgtgccaccccagctaattttttatttttaatagagatggggtttcaccatgttggccaggctggtctcgaactcctgacctcaggtgatccacctgcctcggcctcccaaagtgctgggattacaggcatgagccactgcacccggcctacaatgagatattttctaagaataatacctgcaagtagattaattattataggcataattttaatcagaacaataaaaatttatgttttctaactagtttcgggcctaatagtttagatgcataaggaattgctcccatctgaatgtagacagagagtatgtgatgggctgagtccaagaaaatgaaaccataaaaccaaagtcctacatttaaaattttaaaaagcagcaagacagaatggaagacagcgactgaaacacatgagttttcctgctgaccacaagcaccctagcagtcagaagtgggatgaaagctaataacacaatactcagctgcattaattcagtgggtcagtatttttatcagagagagtaaactttactttgcttttgggttctatccataaattgtgtgtgtgtgtgtatatatatatatatatataaaatattgtgtatatataatattacgtgtataatcatgttttaaagacctatatttagttgcactaaataatcaaagctaaggaaatctggatcttgtgaatttcctctagcttcttctccttattctgctctatgatagctcacaaccatagctaaaacatcctgagcatcttctatcagcagtcaggtactacagtaatacattacctatattcactcatttaagatttacaacaactattattactctctttactgcagatgaggaaacagaagcaccataaaactggggaaccagtccaaggtcaaaaagtttatgagtggaggagctgagcttgatcaagggagtgtggcatctgagtctgaatcctgatccctgtctcacatcatcttttctcgagacagacttggaaatggaagacagagggaagcagtgtagtttattttagtcttggtgagtgggagaaagatgtttaaaatatggatgcagcttagacgttgatatagtttggatgttgtccctgcccaaatctcatgatgaaatgtgctctccagtgttggaggcggggcctgttgggaggtgaccggatcatgagggtggatttctcgtgagtggcttagtatcatccccttggtactgttgttgcaataggaagggagttctcatgagatttggttgtttgtttaaaagtgtgtagcacctccccctcctcttgctcctgcttttcacctgtgtgtgtctgttccccttttgccttctgccatgactggaagctccctgaagactccccagaagcagatgcctccatgcttcctctacagcctgcagaaccgtgagccaattaaatctcttttctttacaaattactcagtctcaggtatttctttacagcaagaatgtcctatagagatgtggatacttttttcccccaatcttggccactatcatgtcctttaagttatcagagatatataggtgtgttttcaaaccagtagtgtatttttgtataaataagaaattagcaattgattctcacttattccatttctccagagatacaatgctgacacatcccgaatttaaaagcattttaccacctagtggtgggtaccttgagaaactgccagatactccaatagctcagagcaataaagaagaacgggggaaaatttgctaacataaattttaagtggaaccatttacatcttggtaaatcttccctatatgtcaataaaagaaaaataaaagcattatattaataataatcataatgagaagaaattatacagtgatatcaatttccttggggagggtggatagtagtataacacgcttctcatttatttaatttttcatatgtggctttttgtactactgaaatggtaaaccatccatgagggtgtggctgaaagggatgtttagtttatgtacaaaaatgcaggagaagcacacccctagtccttcactgacatatttccgaaacatcagaaaatattctaatcaaaaccgctgttgattggaacaggataatagaaaattcaattgaaacaaaagtaaatgaaagaagaaaaacaatcggagtctctattaaagaagaatttatatgtcatgaattccttctattttactgggtaccttatttgatcatttaatacttgcaacaatgttgtgagaaaggtattggtatcctcattttactgatgagaaaattgggtttcagatactgtaggtgctcaatgtcacacacaagttaggcaggtttcaaagaggttcagatgacaaagcctctgcctaggatgacacctcatctaagaaggacagcagtcacctgctcacagggaggtgatccacacttgtgctctgatgccaagtgtcaggtggacagaggtgaagagacataacatctggaaacatgagtagaagaaagctcaccaggagcagcagagctggttattttcgtgaaagataaattgatgggttgcttgctgatagcttgcagtgctattccagataggctggtaacccaaataacttgtggaattctccacagctgaggagaaatggaaaaaaaaaaaaaaaagcactagccaagaagtcattcgattatgctaaacaaaatcaattcatttatgacttttcactttcgtaaggtggggaatgagtggtttcttaacgttcatccagcaattgttttctagcctcattgcacgactgctttttaagttcaccttgacctaaaggcaaccttacaaaatgctttgcaaagttgtggaaatgttgcattccacatggttgtgaatagaaagagcttcttgaggccttgattagagctgggtggagctaagcctgaaacagatgatggctacactacactgcaggcccagctgccctgcccatgggcacaacagcaaacccagagacagtgcagggaggctgggaatgggtcaagtttaaattaggcacaggatttggcaagccactacataaaaatacaacagcccaacagaaggccacgtttgggtagccagccgtcgtcaagtgcaatgtgggaggcgccctgtctggaagagaaaatgggaaagaatccaccataagaacatgactcaaagaggtcagtgatgggcataaaaatatgtccattgcttctcagaaatcttgccaagaggactggatttctaataccagcaagcaccaagaaacagaataagaagaactagattgtcctcctttttctgatgtttactaaacctctattttctaactatattggtggcaggtagcattttctataaaaacctagctttctctggtacttttactttttttctgcctctatagaaatttcaccttagtttatagctggaggaacatactcttcatttaattttcctatctgccttgctgggcaggtggttttggactgaactgattacattttaggtaacaggatatttctcagagacagcatgtcttgctgggtattttgggattcatggaaaataaaaagaaaaaatgaaaagaaatccattcacctttcatggcagtgatttagtagacattctgtggtctctattaggaactgacccgaatagaaagctagattagcctaaaaaaataaaaaaatgtagaatctggtttacaaaactccttagtttctgtttttatgccttagagaacatgtatgagttcaaatataattacaaataagtaaaaatatgtcaggcctatgtttaagtgttttttttttttttgtatttactagcagtgatgtttttgtcaaaacatttttattctctgatctttagtcactttactgtaaaatgaagatgaagtcagctctgcttatctcacaagtcttttgaaagactccaataaaacactgtgtagaatcttcgttaagccttaggtgttcagttaattttaaggtataattttactatctctacaaaaaaatttaaaaaaaattagctgggcatggtggtatgtgcctgtagacccagctacttgggaggctgagatgggaggatcccttgggcccaggagttcaaggctgtagtgagctatgatcacactattgcactccagcctgacagatgacagagtgagaccctgtcaaaaaaaaaaaaaaaaaaaaacaagaaagaaagaagaggaaagaatatactatgtgatagttgttaattagaattttattttgtcttattgaaaaatttcttctcactttgaaatttactagagtaagttggaattattagtttttcagaaacagagagagctggaaagccatctttatgacatccctcattacagaccaaccaccaagtgatctaactggtacatataccttgaaagacatctgataaacacagagcacacctgatgagttaagccaggtggaggtaaaagctacatttttcattaaaataccacagtgctggaaatttctaaaagaccttgagtggtgatagttgtaggggatgccctggccaaagtggcctgtggcgttgcatgctcccacaaaagccatgtaggcaagactcaatggcgttggaaccgtgtctgggcagaatgctctgttttcctttctggaacatggcatgatgagcaagctatccacggctgtcgcaggccatttcacatccacctccctatcttgcaggaggctctgtgtcctgccgaaggttgtcatgaggctctttcccatcaacctacctggtaccagtgaggcatggaattttccccctcgcccttcttggatacagctgcggaccgtaaaaccattcagctctagtatgaaattgacttctcaactacagagtggctcactccctgtgatgcgtgttttccggtccctccaggttgatggtgtcctgtggggacagggatgagaccctgaagaagtatatgctgggttactgaagctgaatcaatgcttttctccaggtgtgtgtatttatgcacctgtcttttctcgaggggactccctaagctcccagccaggtaatatgcacacgatagcaccagaggcaggatggagaaaggaggtcaagctctccaagttcagtaatataggcatgtatttacatgccttttctatcccaggtcttgccactgtctggtgttctcaagtcaggagcttctcagtattttcaaataataaacctctgtggcctccctgggaggctgcatggagtaggggaagaccctggagatctagcttcctctagatccattcttacaataaatccatctctttccagccctgttcctcaatctcatttctcatggtgctgagttccatggggcaaactggttcattaatcacaggtatctccatgttgagagctgggttgtagctctatcctttctgctaaggcaattactgctcttccatcacttcccttcctttattccaaaaaaaaccccacatctttcattcattatttccttctgtcctgttctccttgtccttgtggattaccacctttcgaacatttctttattgcagcttctattggtttggggaagaacgggagactaactctactggccagttttccatctgtaatgataaattcccagcacaggtgggtggaatatgcatccttcttgtattcttagtgcatttcacagaacctgactacagaaggtgctcaaaaaaaaatcagtattgaagaggtggctacatacaacaaatgtacactttggctacaaagttagataaactagcttgttcagcaaacattttcagagtatagtattctatactaggacccttgacactggatgccagggcagataaaacacaattcttattctttattgtcagtaatgtggtgaaagtcccttggaatcgggtgaatctgcaaaatttcagtgggaacaagagcatgcaccacccaggcttatgtcctagtctttccagggtctgggagtaagaaaaagatacagaaacctgattacagtcatacagttaataagttaacagacaacaccctgtggaattaattcacctttcaatattcattataaatgccgtcttccttctttgaatctctgcaattgtggcaagccaagtttatgccgtaccttagcgataaaagtagagatgattaactgtctttctgtctttgtctcttcgttcctttttttttttttttgatagagtcttgctttgttgcccaggctggagtgcagtggcacgatctcagctcaccgtaacctccgcctcccaggttcaagtgattctcgtgcctcagactctcgagtagctgagattacaggcatgtgccaccaggcctggctaatttttgtatttttagtagagatggggttttgccatgttggccaggctggcaaactcctgacctgaagtgacccacccatctcagcccctcaaagtgctgggattacaggcttgagccatcatgccctcctgtctcttagtttgttttaattttaagaggaacaatggtgctttgttttggtttatgccacccaaagaaatagaagtatgcaactttaaaagaaaattttcagccaagggtaaaaacataaaaataaaaataaccaaattggtgtcagatgcaaagaatcccttgaaaattggtgaggattgaggaatagagaaggatactgaagagggatctattattcaaaactcaattaccagaaacccaagttaaactaaaggaagtgggaatttaatgtctcagtagctgcaaagcttcaggtacagctggagccaggtattcaaacgcaattgttaggttcttccctcttctgtactggcttcacgttcagacagatttcattctcgtgtttacacctaacagcttagcaatcagtgcagaaatattctctttccccaacagttctagcgaaagtactggccacaagtctctgacttgccaaacctgagtcacattcctcctcctcaccctcactccagaggactgggttgccctgctcaaaccatatgaaccgagagtcaggtcaggttgttacacaaaggaaatccaaggaaatgttgccaggaaaaggggagaaggcttttaagccagtatatgcggtagctacaattagtgtaagataatactggccctggagttttggctgcatcaccacttaaaaaaaaatttaagttttgaattaagccaaattgcttagcacagaaggctggtttggagtgtagctatttttgaattatttactgagcttcccactgcatttgccccccacaactcttagcatccatctcttgctaaaaggccacctgaccagaatgttaagagaaatatccaatagcctctacagaaagagtagaatatttatttttagctttatgatatttgttcttaaatgcttttcagcctggaatgacttcaatgagatttgtacatttaaaggctgccaaaaaaagaagggggaaaagtcgaatattaaagaaaatctcactcacatccaaaagtggaagattctttaaacttttaaagaaaatgttagttctatttttaactcacttttgggttgtctaaggcttaagactaacataagaagaaataggtcgagcaacaaaaacttgaaaaccaaaagattttatacttgggaattaaccttttattaaccctaaccctaacccccttttgacgaggagaaaaagagagagaaaggagacccttctatgtgcaattcagggttcagtcatctcagaattttccatatacaggccctagatcaggggtgtccagtattttggcttccctgagccacattggaagaagaagaattgtcttgggccatacataaatcacactaacactaacgatacctgataagaaaaaaaaatgcaaaaacgtctcatcatgttttaagaaagtttacaaatgtgtgttgggccacattcaaagtcattctgggccacatgcagcctgtgggccatgggttggacaagcttgccctagatgatttttctaaaaggaaatttgttctgaaagacagtagtcagtatacctttacacaatttcatgaagatgtctgggttatgagaattgtcctactaggaagagctaccaaaatagctcatcaccttgaggtactgtggagtgaaagtgaccaggtgctttacatcaagtttacaccaagctttactttccaaactttttaaactgtcagtacaactccttttgaacatatcttctaggttggctcttggagtgatacatccatcaccccattctactccaaattcatttgaaattggcaattttcaggttccaacttgcgatggcttaacactccaggcctccctaagatggcactgaacatagggcagccctcctggaggaccccacagagaggccatggagcatgagagtgagctgtacctggcatgatgtatgcaacgtggcttattctctttgattcaggttttacgtttctcgaatggagcctcttctaggttgctatccatttacctccccatctctctctctctttgccttttcctggttgagtccttcccgggttaacccagccctcctgatggcttcccttcactttgaaatccacagacaggaacaactctacatttaatgataaactgtcttacattcctccctaattagttcaaattgaaagtttgctctcacatttggaattttagtatggctatgataaatacttgtgggctcctcactcggagcaatctctgaacagacgatctgaagctagatatacaacattctcatatagtgttcagtgtgaatcaatatcaaagtttaaattcccagtgatattaatgaaagaggtgagaatttgttgctcatatcaataagaattagacctaaaatcacactagtgatctttggacttaatttagtgttcattcatttagatacaaactgagtgtatagtttctgtttaaaggaagagtattttgtccgtgatcaccggtgcacccaatggccaattgatttctgtttacattctgataattctttgcttatcagatcatttcacatgagaatcaagccctctgcaataagcagtgggaaaaattttagtcggtgagaaactccaacgcctcaaaagaaagagtgtaactttcaaaactgtcatttttgttctcatggtaaaaatctgactttgtgtcaatcattccccaaatcttcagttgaggaaagaggtcatgctctacattaattacagatgacaagctagagacaaaactaaaagtccaaccttataacttcgcttttctgcctctccctggtcaaaacaaaccctcttataccaactattcttttttatcacttgagtgctatgtacagggtaaaagtaggattacctcagaataataatttcacacataatttttgtaagaaaagggttcatgataatacttttaaaaataaacagctagcccaaatattcctccataacaaaatgtgacaaaaggaagttagaacaaaatcttaatttacacagaaagtaaaactgtttccctgtaaacaagctgggctgtcatgaaaatggataagggttcacagaaatttgacccaaagaataaagaatgaacggatgacacaaaaatggctaactggataaaaatatgttctgtgtgattaataataagtctccaaatcacagtacttggagagaagggatgggcatactactgtggaattctggatgtgtcaagatctggcctgggttctgggaacactggatctctttgttcctctctctgctgttcagggacagtggaaggggaggaaaaagggatcgtggtccagtgtacgtggctcagggactgggcctctggaagccacagggaccagcgatagtcacacttcttcagccctccagcgattgctctctgtttctgttctgttttcacactgttatccttcagcacagctctgtgcgctgtttgcctctcctccactggtggctgctctctgctaaataagcatgccacttgttcactgggtaaagtgaaaaagacgttgcttgtaaaataattgagtctccaaaaaaagaaaaagaaagcgtctggatcactatccgtgtcacccctaccctgagaagtctcttaccggggtgacttttcttcaaagaaagcattttccaaactaagtgcagaatgaagcaaaaaacaggaaagaactcagattattttatgacgtcacatgatgctgaattacagggtggaaagaaacagaaacacagaccactgacttattggagagagagagatatatataccatgtatacgtaatattatatgtcatataaaatatatttaattacatataatatatatttatagatctccatggcctgtgcttctatggaatcaaattgttgtgtatgcatctatgggcatatacagaaatattatatattaatatataaataatatatatgttgtttagatggagagagatcagaggagcactgaccatggaaatatagataatatacaatatatataaaaacatataacatatttttcctgtgatatgtgcttctggtctctgtgtgtgtgtgtgtgtgtgtgtgtgtgtgtgtgtgtgtgtgtggcataaactgatactacaaaagcacagatcaccaaaatagtatatataaaatatatatacagcatattatgtattatataatatgtggtctgtggtcctagatatctatacacacataatgcacacacacacgtaagttatgtgtgtgtgtgtgtgtatatacacatacatatacatatcctaatctggtagcacttttgttgttgttgtttagattcagggggtacatgtgcaggtgatctgtattatttattcttccttgttccatatatattagattaaccaagatttaaatatcagctctattactaacagtaacacctggaccaagttatttaacttctgtttacttataagaccataaatatataaattaatacatttaaggaatacttactgaatgctggtagagtatgagcacttaataaatgctagtagttgctgacagcacttatgaccaaaacactttcacaatcatatatgcatcagagccagggctgccgtttaaaatataatgttctcatttgcaacgggagaaatggcacgaaaatccaggcccctctaccaccggtatgtactctttccactactcagacagaggaatacttacatttgaatgagaatatccaatcttctaaaaattaactgtaaaccaaacgacaaaatttaaatggagagtgtttggggggctctggaggaatttgaaacttgtatttaatttcctggctcttcatcctgaaatgcgtctaagctagtaacagacagcaaaaccgagttcctatctctctagtgttccctgctgagataaaagcgatgtgcagcaccggatgccaacagagcaaataattacactgagtgctctttccacagccaatgaatcggaaagtgaaatttttgtggatgcacctgagtgctggggacatcagctgtcctatgagaagtcattaacattttctgaatgtctactgtgtgccaaacactgattactaaagaggacgcaaattgaaatgagagattattcttgtactccaggtgcttaaagccgttattaaggatcatatcacatgtccatcgagaataaaatgtcaggtaagaaaaattccatgaagaagaacagagtgctaggaaaatgcaagaaaaggaatgattaatgccagctagcttggggagggggctatgatgagagaaaggctaaggacagggacagtgagacagggacagttctctctcctagaattattaggaggtaaaaatttggagctcttctacttatgattaaacagaaagaggcatgaggagaaaaccaaatgatgtcatcagaataaaaaggcactgcaaaacagtagattatacatgcaccttgaatgtgctgtctgataaatcagcattttacaaaaacacatccggactagcaattcagaagaaagcaatgttaatgcattaattcaaagagagcaagccatccccaccctcaccccataggcttttatttatttatttatttatttattttagcagcctataatctctaggatttaaaaaaataactcaccaatgaacagaattaaacttctcaggtctgttgctttaaagaatagccaatatttgtgagaaacaatttcaagagaagattactacaaaatgaaaatgtaatatgtctgcatcagttaaatctcccaaaacaaatttgcaatattgcctctgactttgacgattttattctttcagtaacagtccagatggcatccaatgagtattgacatcatcatcataaaaaaaggctaagaaagtcaaaatgggatttatttaggacaaaaattaatatcaatagataatgatcttaaatttaaaggatgaggcatgaaaaaaacaattaataaaccttttatcttcctggaagatttccatttgatatgtatagtcatttgttgtgaggaatagaaaaaaaaaaagacacattaaagagtgtaaaaggctataaggtaccttgagaatgtagaaaataattattatttaatgaaagtgatagctaagaattcaaaaaataccctttggctatctgataagaaaacctatgccgatactatagcaaatctaacataagtaattttttggccttgcaatagattaactacctaggacgtaagaaaatgtctaaatctgggcttaatccaagcctctggaggtggtaataaagtcattaataataatggtaaaaactataataatcttttcagtttttgctcaccttctatgtgttccatacaccagttagaaatactgaattgtccagtgacatcaccataaaaaataaggataaagtccaaatataccatttttttcttgttcatctgttgtgtatgcgttatccagagtcactcttttagaaccatatatatttttaacacatgactggtaacaagttctaccttttaattacataggctaagtaaattactaacatctcttttatgtctgaaagcttccttttcaaggaatgccttcttatggaacctctcaagctctgtgaagtctgcctgaagactggatttaaaaatagcataaaatggtcctaatttaatttatggcctgaggagcccatattcacgtggtttcgaatatgggtaggattgttttctttttctgtccaatatcctcccacctcactcaagaccttacgtggtcttattgatcacgggagcacactggagcggtgactttatgaactaggctatccgtgacccttgggtccctttaatgggccttaactgttagtgctgaacctgccctcccaaaagtcacctttgcattatttttcataaatgtattattttctatgtgggtcaactggatctctcttgataactttctgttcttcacatatctcaatgttctcatctttttttctttcttggcttagatgcccactttttagtacagtctgacataatctgcaagtttgaaaattccagatgcctataaagataacatttaaatgctagctaagataaaactcaacaccagctgggatcccccaaacttccagaaagttgtttgtttatgcctgcactatgtttgctgccttttatgccactccttaacctgccaaaacagtcccaaacactgccatggagaggcctatttggggtagaaatgtattagaggtttggggaaacactaaataaagtacatcgatttcccctttcctcaaagtcaagaaacaaagttacaatcttagtgaagttcaatatttcttcatagactcttggccttgtgcctgcacaatgaatggatcacgtcaggttcccatgtagggatgagagaacaggaagttcattcctatgattcttggagtctttttcagagagtacttaaggataggcaaacagtattctgtaggcacagtgatatatgttgcagaaaaatgtgcattttggtccatcattaatgatttactgttgagtacagtttacaatcttaagtaaaataattcatctccagagatttatttactgcttttggccacacagcaataaaatgatttggttgtactgagaagaatttccctttaccaaggccatcacagggagaaggtatggtgttccaggtaaaggatagcataatagaaccatttcagtcaatcaacacagttggtagtcagagagaaggcttctttgtagatgttgatagacatatttatgtatttggaaagaattttccctttatggaatagagttattcagaagacaaagggtccagctaagtttgggaataagtcgatacacctgagttacttgcacagaaatatctcaaaggaattattgtaattatgtaattattgtaattcccttgagatattgtaagtcaatggaagctgtgaaggttttattttcccaatccaaaatcacctccagtcccaataatattcactccaaatataaaatggcaaattcacatgttcagaaggcactacacagaagcagcaccacaagcgacagctatctaggaaaagaaaacagtccctgagactagaatatatggctacaaagaaaaccaaagctaaaatcaaagcatttagatattgccaattttgtactgttccttcgaacattctggtgaaaataagtcagagcttgtctttcatcttggtcgtatcagatggatccaaccacatttaaaaacaaatcatttctctaattactgtgatggttactagaggctgggaagggtgaggggtgataaagcgaagttggttaacaggtacaaaaatacagtctgatagaaggagtaagttctagtattcaatagtacattatcgaaattacagttaacaataattgttgtgtatttcaaaatagttagaagagaagaattgtaatgttcctgacacaaagaaaagataaatatttaaagtgatggatatcccaattaccctgacttgatcattacccactttatatatgtatcaatatatcacatgtactgccaaaatatgtacaactatgatataagataagataaattatttctctacaaatacaatgagaactttgtcattgcccagcaggatttagctattagaaaaagaattatattaggctgggtgcagtggctcatgcctgtaatcccagcactttgggaggccaaggcacacgggtcacttgaggtcaggagttcaagaccagcctggccaacatggtgaaaccctgtctctactaaaaatacaaaaattagtcaggtgtggtggtacctgcttgtaatcccagctatttgggaggctgaggcagaaggcttgcttgaatctgggaggcaagaggttgtagtgagccaagatcatgacactgcactccagcctgggcgacagagcgagactctgtctcaaaaaaaaaaaaaaaagaaaaagaaaaagaaacaaaacaaaacaaaacaaaacaaaacaagacaaaaaaaaagaaaagaaaagaaagttttatgtcagagcccaagtggttgagattaacattctttactatttctaaccacttcaaggtgctaatttacaataaggaaagagtaacaaccattaggggaatatagactctttcatagcaaggttaattgaagtgtccatttgactatgtgacatctcactttcccctcttgttccgcagctcgattggctatgtagttattatgtgcaagttgcatagttactcagttctgtcagagaggatgtgtgaagaagatgaaaaagaaaggactagctttttgcaaattggtcatgtctcttgcggatctagttaacatttcctgttttctgcaagaattaatttttttcctaatgaactttaagaactaccaatatttttagtatactctttctttcttatttatttgtacattatctgtttgtatccttgaattttctctgggatgttataaaagaaaaatattacaagcataatttctgacacaatgttttataactgttttcaaaagcaatctatttctctcttaatttctatagaacccattttagtcattcctatgatgaatgaaaaaaaactcacaattagttgtcagtttcagaaaggagtctcagaagcatcttagaaccacctaggcggtcttataggcgtcacagaaaaatattccaccttacttattcttatcttcttcaaactgactccaaatataataagcaggcttaagttatataaggttccttaaaagttgttctcaaaaacaattaaatgcagactgtcctcagtaaaacttgcattggcccagtccattttaccaagtttgctccttcttacatgtacgactgcccctgtgacaagtttaagcctacgttaattaatcatctttccataacactgagacatattcatccaaccctgagagggataaggggtaacaggcaagatatattcaaattgtgacatttaaggtcaacttgactttaaaactcatatactgctcagttttcatatacgtggctgaaaacaagtcatcacagagaactggtcacactgttagaggaccaaaatagtaaaatatgaacaattcttccatatttaatgatattaaatataacaggtcctatgtctatgcaattgaagtcaacatgtcactaattagggcttcctttgttatcaaacttgctgagaagatagaacagtgaggaaaaaatagcaggaattgagctgtacagaattaaagacattcttatgaaccttaagacttaaggtcagtcacactcatatgacatttggactattagacaactcttctgacctcaaattttgctcttaccagttggtgataatcctttggtaagagagcatgttaaaagtaaccaaatcagataaggactagaagtcaaatttcaacagaagagggcaatgagactccgtgccttaattatcaacatttttatgatgaagaaccttcctaaactaatgaaaaatacaagacagaaacagatgaaacacagaaatggctgaaaagaactccctattaatttctgaccattttcttccctattaacagtgcttgatgatctggagtgaatacctgcctttttggctcctgccaattagttcaggaagttccatcttcaaacacattcagtgacctgatttaataggggcctttttatttgatcgccgccaacaggcagtcctacagacttttataatcacagtgggctgctttacaggcaagtcaaattccagtttaatgaaaacctacatcattacaaggaattgagaagggaattctggtttcttttctgctatggcttacactggaagcatagtaactttccaatgaatccatgcaggagaatggaattcatccaatagggaaagcctcatttttctctatggtagaatggtagaattaatgaatatcaagaacacgagaacattttgtaacatcctgctggttaagtatgtttcattcctagctaggttaatatggataggctgggggcagtggtggtggatatttccagagatattacctgaagtttaacaaaacattggttttaagcttgtacatcatgaactcggggacagcttctctctcacactctatttatttatttatttttgagacagagtctctctgtcatccagactggactgcagtggcgtgatcttggctcactgcaacctccgcctcccagggtcaagcaattctcctgactcagcctcccgggtagctgggattataggcccgcaccatcatgcccggctaattttttatattttttttagtagatatggggttttgccatgttggccaggctaggctggtctcgaactcctgacctcaggtgatctgcccacctcggcctcccaaagtgctgggattacaggcgtgagccaccacacctggcctccctcatactttcttatgcaccaatcatgacccattttgaaagaggcagagtggtggaaggtttggacttcatgtgctgactggttctctttgttaagactcaaataaaaccactggagtcctatccactgaatgctagatctcaagacatagcacaatgggattcctggttacttacaagcggtctttatggttccccagaacatcttcccttgagcctgcttcccttgctgctccaagtgaactaaggccagaaactaacagcaagcacacaggaactgtgggctctgtgctcccctcggtgtttctgttccatagaggcccatcatctttagcgacttgattttctcattccacacacaactccaacaggtatctcatgtattcattggtttcaaatatgtgtgtgaataaatccctctaaatttcagacctgtatatccaacagtttccagggcatctcatctggttgttctacatacgttgcctgaaagtgaatatagccaaaacatatcatgccttcgtcattctctccatgaagaaagaaaggaagagagaatctcttgtgtttcccaatgtgaaaggcatagtggtgcattcattgtcaaagtcatacatatgggtgacatcactgttggtagggccttctcccttaactcacctgcccccctcacttcccgcaccaccacccctaatcctcccattgagttagtaatgaagtccttcctatgtcctgaaagtctcccgtgcatcctattttttcttaaatctcactggcctgccttgggtcaagccttcatcatctctgctctagactacagccacagtacccagccttgtctcccttttctaccatctgatgtttattctctacatttccccccacccagaggaatatgtttggaaaaaaaaaaagaaaaacaaatactgctatttccctgctcaaaattttcaatggctctttactcttttcaggatgaaatttgaactcctccagattctaactgttgtcttctgccttcctctctggagtcatccctctgcactttccaaacacctcatcctgtgcaaaggtcacgcgacaatatttggagttcccagagctcgccagaccctttcacaccttcgagctgttgcacaggcgctcctcttttccctggctaagtctgactcaggctttacaatgaagctctgacatcaccatctccaagaaaagcctctgaccccaggaacctgagtgaaattccacacactcctgcagccctctgggtttacctctattgtggaaattatctcactttcttgatttgtccttctcctccctagactgtgatcccctcgaggacagacagcatggcttaattctctgtatcgctaggcctgacaaaacgctcacacacagtaggctcctgaacgatgtttaatttattgttaacacataggattccacagatcctgaggtacagcagacttcagatacccacttcaaagaaaacaagggagtaatgcctaggttcttgttcctatgatttatactgtgaataaaataatttcagagaagttcctttattcacttgaacaatatttaaagggcaaaaaaaattaacaaaaggtctttttaaaaatgcaaataatttacatttgttgataaagccatacaatcacaaaagtgaccatatgaatgcaaatattccttctaaaaagtataattattattcacccatctaacaaatattaatgaacccctctgatgttagatgctctttatggtacaggggttagcagagtgggtacatggaagcttcctgtagtttacactatcatctggaaggcgattaatcaaatactacttactgttcatgagtttataattataaaatggagggaaatactctgaaagagaagagtgtggttttataaaaccatataagaggctgggtgcggtggctcaggcctgtaaccccagcactttgggaggccgaggtgggcagatcacttgaggtcagcagtttgagatcagcccaggcaacatggcaaaagcccgtctctactaaaactacaaaaattagctgggcgtggcagtgcatgcctgtaatcccagctactcgggaggctgaggcaggagaatcgcttgaacccagaaggcagaagttgcagtgagctgagatcatgcaactgcactccagcctgagccacagagcaagactccatctctctctctctctctctctctctctctctctatatatatatatatatatacacacacacacatatatatatacacacacacatatatatatacacacatatatatatatacacacacacacatatatatatatacatatatatatagaaactggcttagacctaaggtgagtgggtctcaactgggcataggggaaaaggagggaaagcattttagatggaggaaaaaacagggcagggataaatcttcaagaccagagtggccatggaaaagtcacctctataactagaatcaagagagtgagagaggaagtgataccagatgaggtctgagaggcagggagggactgatccaggatgctgcttaagggtgaagaggatcagaacacgccaccaaaaaacataccattttggcatactgattattctgaggtaaaggcaattgagaaacagaaaatgcatgaagggctctccacctttcccttttctgcctaaaagcaggacataggtaaacgtacccttgccaaaccccaaaaaccagagactaaaatgaaacacagtcagagcccagaaatcatattttaaccatgaacaccccaacaattaccccctgattgacgtaattttcctaaaaatcttaagcccctccaactaaattaatcctccattttgtataacaaatataaaaactaaacttccaccgtaatactaataccttcagcatatccctctgaaaatgtgtatgtttctcctgttaatctgtcttttgttatcttaattagtaagaaccataaacagaccataagagagaacaggagcactttgggaggaagaggtgggcagatcacgaggtcaggagatcgagaccatcctggctaacacagtgaaaccccgtctctactaaaaatacaaaaaattagccgggcgtggtggcaggtgcctgtagtcccagctactcgggaggctgaggcaggagaatcgcttgaacctggcaggcggaagttgcagtgagttgagatggcgcgagttgagactgcgcgactgcactccagcctgggccacagagcaagactccatctctctctctctctctctctctctctctctctctctctctctatatatatatatatatatatatatatatatatactggcttagacctaaggtgagtgggtctcaactgggcataggggaaaaggagggaaagcattttagatggaggaaaaagcagagcagggataagtctccatgaccagagttgccatggaaaagtgacctctatagctagaatcaagagagcaagagaggaagtgataccagatgaggtctgagaggcagggagggactgatccaggatgctgcttaagggtgaagaggatcagcacaccaccaaaaaacataccattttggcatattgattattctgaggtaaaggcaattgagaaacagaaagtgcatgaagggctctccacctttcccttttctgcctaaaagcaggacataggtaaacgtacccttgccaaaccccaaaaaccagagactaaaatgaaatacagtcagagcccagaaatcatattttaaccatgaacaccccaacagttacccctcgattgatgtaattttcctaaaaatctaagaccctccaactaatcctccatttttgtataacaaatataataactaaacttccaccctaatactaataccttcagcatatccctctgaaaatgtgtatgtttctcctgttaatctgtcttttgttatcgtaattagtaagaaccataaacagaccataagagagaacaggagcactttgggaggaagaggtgggcagatcacgaggtcaggagatcgagaccatcccggctaacacggtgaaaccccgtctctactaaaaatacaaaaaaattagccgggcgcctgtagtcccagctactcgggaggctgaggcaggagaatggcgtgaacctgggaggtggagcttgaagtgagccgagatcgcgccactgcactccagcctgggcggcagagtgagactccatctcaaaaaaaaaaaaaaaaaaagagagagagaacaggaaaactttttttcttccatagggatcttgtttggaatttcggtcttaatcctaaaatcaaagatggattttaattggacaggtttgcaatttgaaaatagtagtgtggctgccctttggagaaaggcaggatgaggtgcaggtgcatgtggagactagttaggaatcaatgagatagttcaggtaagcggagataagattttgcagtagagaaatacaagcatacatggtccaagctaagctgacagcacttgtggatgcaacagatatgagaagagggggataagaagagtcaaggcgaccccggcatttctggcatgtgcaatttttactgaggcagaaaccagggaaggggctgagggtaagacaatgactctcatcttggacatgtgcagtttgagacttctttgacatacccaagcgaaaatactgtatacacagttgaatttactggagttcagagaaaaggtctgaattagaaacatacatttagaaatatttaatttaagccatgagacggatggcattgccttgagaaaaaaaaagtagagtgagatttccattgatgtgttgctatttcaattaccttgtaaatagtctagtttattattatcttatcctattaattgttcttccactctttctccttcactgggttctctgaattatagaatttatgcagaaaacaaacttggagatcatcagatataatctccaaattttacaggtgaaaaaactatagtgggttactcaggatcacactgctccttagaggtaaaaatgaagacaaaagctcaggtgtttttgatgagtactccacaggactacatctggaacaggagcatgttgggagatgaatgtaagagtcccaggtacccagaatcctaccaattctgacatgcgtgtgcttgtcataatgaaacaacacaggacatcatgtgaaggacaactaacgtggggttacccatgaggtggtgagaaacagaatgggattttgcctcaaacccactgtggtttacacattagtaaactgttcaaaatggggccaaaagcttgaactctctgaccctctatttccttctctaggaaatggagaaaagcaatcattaccttgaagtgttgaaaggaataaaacgaatgtatttaaagccactaaccacatagaaggtttccaaattactaactaatattttcctccaaagtaaagaaaaaaaacagatgtcatcaaaataataaagctggccgggcactgtggctcacgcctgtaatcttaacactttgggaggccgaggcaggtggatcacgaggtagggagatcgagaccatcttggctaacacggtgaaaccccgtctctattaaaaatacaaaaaattagccaaatgtggtggcaggcacctgtagtcccagctactcgggaggctgaggcaggagaatggcgtgaacccaggaggcggagcttgcagtgagctgagatcacgccactgcactccagcctgggcgacagagcgagactctgtctcaataaataaataaataaataaataaataaataaataaataaataaataaaaaagctggccggatgcaatggctcgcatctgtaatcttaacactttgggaggaagagacatgaggatctcttgagtccaggagtttgagactagcctgggtaatgcagtgagaccctatcactacaaaaagtttaaaaaattagccagatgtgttggtgcatgcctgtagtcccagctacttgggaggctaaggcaggaagattgcttgagcccaggaatttgaggctggagtgagccatgactgtgccactgtgctccagcctgaatgacagaatgagactctgcctcaaacaaacaaaccaaaaaaccaactttattatttaaaaaaatctcaagggctcattgaaattatttggaaacattaaaatattttttaaaatattaaaaaagcaattattccggtcatcagggtttaaagcctatttattatataatgcacctaaaatttataaagcacccatgattatgaatcaaaacatctatatccaaatagtatttgatattattatactgtaatgtattttctagaatacagcacacaagaaaccacgtgctatttcaatatcttgttaagcaagtgaaaacctatgttgtcagttttaattcactcaaatatgcctgtagccaaggtaaatggtatagtttaaaatagtaccacaaatgaagcaactatcttacaaatttaaaattaatcatttcctcttttattcataaacttttatgcttcatctggatttggatctctattcttctaaaatttagagttttaagtacaaaggattttttagctggtatgagtgttatagtttgctttaccaaagattttcagatgagagaatgaataaacattgtaagttacaggatatgaattccagggaaagagctatcatgcaagaataagacttatggatttcatttacagaaaatcttcagcaaaatctacaaatatatttttagctatatagttattttttcaatttgaagacataatggtgttaacagtgactgagcacttttatgaaactctcatggaataatatttgaacttcatctttttctattgtggtagagcacttgttcaaagccaagatgtatatccccacttgtatggggcagattccgggcaaaaccactccttaccacaaagcagacacttctcagatgcctcttcaggatttattccttacctgccttcaaaatatgatttgaagcaatttacaatatagcccccaacaaacttaaaagaacaacaataaaagatagaaaaaaaaaacaattagaagacaaagaaaggcagatatgtcagggatgaatcacatgagaaaaagaaagaatggaacattaaatttagcagtgaacttcttggcaactacagaaaaaaggaaaaggaaaatacaaattatacattattgtttttaaaaaggaaaaagtaaagtttatcttcaaagacacaattttttagtagtttattataaaatacatttattttattgtttttttcattagaaacttagagaacatgaaggaaatgtcttttagtacaatttcgcagaaatcacaaaataagatacaaataatcatctatctgcctgctctaaaggctttgatactattatactcaaacttcttaaaggtttttttttgtagttaaggacagacaattcaagttctttgttgaagatgagattacaaagttatagcctttaaacagttctgttcctacacctgactttttaaacctctgctaaaggaacttaccttggttcctcgtacaagttagttacacgtttattgctaatgtatatgtaatctatttccccagcaacggtaaaatactagcccacaaaacccagtatagttactggaacatagtgagtatttgatcaatgttcattgcattgaattaaaaatataaagaaaaacgtagttagcatgcatctaagaccagcagacaccaatcccatatttttaaaatcagcttaaaaatacatatttctataacctgagcttaatatttaatctaggggaaaaaataaataaaataaagtaaaataaaaacaaaaattatagattccctggttccatctcagcactaatgaattagaatatctgtggtttgcatttgaaatctgcattcctaagaccttctccagagaatttattgcagccatactccagagtggcatttcatcaatcccaaatattctccttttataacatttttcatgtacactccttttttttttgcaaccataaatactttgtgtccaatacatgtgctatgggggatgactcctaggtataattagaagaaatattgagatgggaaaagtttaagctagaaaagggaagtcgaagtcgaaaacatagtgaaacaaaaggtagatgttttactgtggaggattgaaggagatgaagaaaccagaaggaagtttgtgcagactgctggactgtgcctgaggactggggcaagagctgcaaagctaccagtaacccagtactctctgccttatcttctctgcttctccttccttacatgcttcactgttctcaactgcagacaggcttcctttgctgctctctgcacaggggcattacccagcccctaggttacattgcctcagtgccagacatacataaacacacacacacacacacacacacacacacacacacacagagtcacacacacacttcaccaaagttctgggaatctcaacagaagcccaggggagagagctgttagtcaaattctataatgtacatacaccactgatctcattccctggccctgagacaccaggtcacatacaacctgtgcagctgcctgagctatctctgcagctgagaaggcacttctggagaagaaggtaatgctgtgactggatgcactcaaggacatttctcatctcagagttcaaggaaatggcatagaggaattatccaaagatactgtcctatggtcttgggactatggaaaccaggaggttgaaatcaacaactctaaaaccaaaacaaaaacaaaaacaaaaacaaagaaaagtcttagatgtttcactggacaaaatgcatttagcaggaaaaacaaaaacaaaacacaaaccctattattaggtagattatatttgtcattgcattctttgacatgatctgggtctggattgcagatgttgcagggggaattggattatagcatcactttctcaacacagctgttttcacttgaggtggatatgggcattacttggccaccatgacctatgttttcctttgaagcatgggagttgtctggtggagttgggtagtgttcattctcccacaaagctgttgacagctatcaatcttaggggcaacagagactctcagcttgggagtaaaggaaggagaaagaactagattattcttcctaactgctttttccttccccaagtaaaattttttttaaaaagtcattagataggctggggtggccttgattgaggccagactgcagagatgattagagcccttcaaagaaaaagattggcacaagcaaggtggccactgatcccagagctctcaataaaacaagcatgctccccggagctgcccagcttctctgggtgcattttaaggcaatatgtcttaaactttagtgcacaaattgaggttctaatttagtacatctgggggtgggtccagatactatattttcttttaaaattaacaaataataattgtacatattcatgggatacatagtgatgttttgatacaaataatatatgatggctgggctcattcctataatcccagcactttgggaggccaaggcaggaagatcactggagcccaggaatttgagactagcctaggcaacatggtgagatcttgtctctaccaaaacaaacaaacaaaaaattaaaaatcaaccaggcatggtggcaggtgcctgtggtcccagctacttgggatgctgaggcaggaggattgcttgagctcaggagggtgaggctgccatgtttgcaccactgcactccagcctgggtgacagagcaagactgtatcaaaaaacaaaacaaaacaagaaacaaataatgtatggtgataaataatgaaaagtgagaaatgataaacatttatcctttttgagtaattaacatatccattatcttaaatatttatcatttctttctgtcaggacggctcaatgtcctcctagctatttgaagctacacaacatattattgttaactatagtcattctacggtggcatagaacactggaactatgtggctgtaatttcgcattctttaacacatctctccctgtaagtttccaagtgattctgatactaatggtccatggaagtaatgaggctttaaggagcacaaattggtaacttgagaaagttagatttacaacatttgcgatccttccttccgtgtggaacagtccatagcaaagattgactccagtctgcaacaactgcactaccctcctttcacatatggcaggacttcatcacaatggtttctggttctactaagggcaataaagtcagcggattccttgtttcattagaagctctgcagtagaccatgaaacatgctcagggagagaagggggaagctgaaagagctgggaaagccagcagtccgttgcgagttgggccacaaaagaatagaggaattaacaatccccacagattataagaaaaatctggggagggatactaactagaaaagactgaaaacttctagtaaagtgaatggagcttgagaacattataatttgggaatattaatataaagaagctgataagtgctagacataatactagatataccaactaaatccacgacaaagcatctaattgaacctacgaggcagagcacgcctgcaaagtttccagggaatataaaatgattacttggacctaattacattaacgtgaaaaatgtcattgatattctctttattgaatagctaccactgttattttacagcagtgaacattaaaacaattattagagattcccaggttaattctcaatctatatgtccaatcttatttttcaattaaaatcttaatgttgtcaaccaagaattcttccaacagcttgctgttgagatatttgctatctgaagaactcaatcaaaaattttagactccactagagtgggtatcacaaaattgcagccaaacttaatcagatgagcaaagttttttgtttagcctatgtattttcataattcctgaattagaatgcctctaagcaggccatacacagtggaactgaccagttcccagtgcaggatggcaacgtagtgcatttatctgcctgaattctaaaggagataagttcacccctttcattagctcatcaatatatatatgagtaacatttttatatgcgtgtttagatgtggagttaactctgaatccttgaccaaatggagcttaaggtttagctagggacatgtgcaaaataactctaagacaaagtggagcgtacaagagatgcaaaaaccaaggcctttgagagcacagaggcaaaagcttcaggagagttttcaccaatgagctctctgaactgactactgaagaatggatggaatttaacaagcagaatggcctgtaagtgggacggtgaggagaggagaaatggagtgaagccacagatgtaaaaagtgcaaggcatcattgagaaaaagcaagaaactagaacgaagtgggcataagagggagtaacagggaaaaaagaagacacattttgttagagcaaaatgtcattccacagtagctctcctcagctccaagctccctctcttctctctgacagcaacacaggtatcaaaccccgacacggaggccgcttccctattattcctgtcctgatctctaccctcttcctaggcttgacagcttcctgatcatgaatattctcttgatcctggtcatgaggaagcagcctgcaacccctgtacaggaatcccatgaagcacccttcccagccacactcagcatcagccgccttcttctccctcctcgctgctgaggcttcgggctgtctgatctcacctctttcctaagctgtgccaggccatgccccagcacatcccaggccccaaaactggcactttcactgccccctggagtcagagcacagaggcttatcttattactcttccttgtgtcttgggtttctccagtcattgccaatcaaacccgcgggggttcctcattttggataatgattctttcctctctcagtctcctcattttaaaataaaacaccaacaacaaaaaaatgaaatccattgggctatgtcttttattctgcatgcctagttattcactaaaccctcacgctctttcctctctattccttcagcccttggatatcaggacctgggcacccaaacctgttcctgcaacagccttacccttgtcacagtgctattgcccttactgaatgccaatttatcccgagcactttcatcacaatatcctctgccaaacattttaaatgtctccatatttccccttttatcagaattagattctttggctagctttcacagaccctcataacctgacccaagttctctacagtttggtcactgtcgagttcggtgagcacagttggtggtgacagcggtcttgagcgagtatggctcttcctcatctttcaaacagctcaccactgctctgcagaaaccctttccttactccccatcagtcaggaaaaagaaatcactgatttttttcaccctcctaatttccatatacaaccttcataacattgttttttatacgtctttatttattttaatattgttttacttcgcatttgttcattcggtctttacaaactaacctagagcagggtcatgatttttggcgttttgttttactatcatttcaagtgtttcacatgataaatataccacaggcattttataagtagttactgaataatggattagagacagagtttcaatagtgaacagctggaatcagttttaaagagttatctaagaggtacaggagaaaacagaactgtgctccatgcagacttaccagagaagacgctaggtatcttggaaagaaagcttttgaccgtacgaataggaattccatttttttcatcttgcatccgtgctatgacgtcttccatctaaacaataataacataattaaaacctttataaagttgaacttttttgaaaaaaaatcagctctcataacaattttgtattcctgttttgcccaactaagaacaatgccgtattcttgcctttctagtttttgccacattaatagtttaaatactgttaaaaagagatggaggaaacagcaagaaaaacagccatgttagggcccattaagctaccaataggaattttgtgctttgaatattgcctttctcctgatttcatgtaccttggttataaaggttaagatcaaagagtgtttatttcacaaggttttagaaaccattgtcatagcacattcatgcttcattaatgttacctctactgaaatcagtgcaaaagcaagtagagccttaaaagcatctgcttgaattgcttcttcaagcaagagaatttccgtgattttgttttacaataaagttctaaaacctgcctagaaatccaggactgattgccaactactattacatctcttgcccgggtacttactgaagtgtgttatgaaacaaatacacacacatacacactctcatgcacatacactcatgcatgtgcacatacactccacacatgcacatgtacacacacacatatatgcacacaagtacacatacacgtgcatgtacacacacatgcacacacacacatatgtatacaataaaatgaatgtaacaccacagccttctgtccgtttactagattcccctttatctttgtttcaatctcattagtacactctcttttacttttacaaattgctggtaattctaaagggctgtgcttcacaaagtcaatgtggaatttagttttgaagaacattcattcattcaaatcatagccacagacattactcatgtgcttctaaacctgggagatgcagagacacacaaacatacccaagtggtagtatgggacttaaaatccattcatccatttactcattccacaaccacttatcactaactctacaccagacatatgactgggcaccgtggatatgaaaatgcatacaatacagttcctaccctcaaaaaattcagtcaatagtgacaaccaaggtgaaatctgagtaaagtatgtagtttagctaatagtgttgtactaatgttaatttcttgttttgataattatgccatggttatgtaagatattaacattaagggaagctgagtaaagagtgtatgggaattctgttatcttttctttttatctataagcctaaaattatttcaaagtaaacagttaaaaaaaacacagtctaaactttatattaatgaattatcaaatttccattggccgggcgcggtggctcacacctgtaatcccagcactttgggaggccgaggcgggcggatcatgaggtcaggagatcgagaccatcctggctaacacggtgaaaccccatctctactaaaaatacaaaaaattagccgggcgcggtggcaggcgcctgtagtcccaggtactcgggaggctgaggcaggagaatggagtgaacccaggaggcagagcttgcagtgagccgagatggcgccactgcactccagcctgggcaaaagagcaagactccatttcaaaaaaaaaaaaaaaaaaaaaaatttccatcaacatagctttagaatggttttcagctaagaaatctaatgttcttggtatcaacggatgtattactatgttgtaatcacactatgaacagatgtattactatgacaaataactggagatgtggaaagaatgggttttaatgaaacacaggtttgtatttgactcttagctcttgtaattattatctatgttctttgagtaagttaaataacctctctaagactcagttttctgatccataaaatggtgataataatacttgtaataatttcttcatagcgttcttcatgggattgcattgggcctagggtggggtaaagtattttaagggcaaatgatacaacatatataaagcctggtacatatatagaacaacaaatattagaccaaatgtccatgcacacccacgatatctggggatgcttattctccaccttcatgtttctttccatgtggaaggagcgccattaccctaatccccttgccttgtctctgccccctaatttactccaggggagctgagctgacttatcagacagaagagctgggaatgagaaactggcctgcagggcccactctttttctcttggctagaagcccacatctaactctgctgatgtagagatgcctgccctagtgggtaagcaagtctattcaggattgtgtttcaggattaacagtgacttgtgcacaaacattcttccataatacctttatcagcaatcagggtgatgttgtgacccctacgtgcctgtctttatggttatagttctcagttggctcagaaatcaagtataaaaagaacatgatgctgggcacggtggctcacgcctgtaatcccagcactttgggagaccaaggcaggcagatcacctgaggtcaagagttccagaccagcctggccaacatggcgcaaccctgtctctactaaaaatacaaaaattagctgggcatggtgacaggcgcctgtaatcccagctactcgggaggctgaggcaggagaatcacctgaaccccagaggcagagcttgcagtgagccgagatcataccactgccctccagcctgggagacagagtgagacttcacctcaaaaacaaaaaataaataaataaataaaaaagaaagaaaaaaaatgattttatcaggcctgtaaaagaccccaacaataaccaaataccaaataccccacttcttttgtaataaagatctgtaataaagatctctaagtatagaaacatgaaaatagacatactctgatgactttttattttgttactatttgttcatgactgacctgccacaatgttcagaaatgcagaataagctgctttgtcctgcctcatatcagcctctaaacccttgtattatctgcttaacggtttaaagcaggctggattagagggacatggaaacctctctgactcacactttcatctcagcacctagagatgtggcagcagtcacctctgcttcgggctgaatttaggtgcgtagctatgagtggcagtgttttctttgtatagtctcatcccctctcagttcatgggatcccaaaggagtgagaataggaggctggaaagtaaaagtgacttctgtggttgtattccaaaatattccatttttctgagtcatcatttccacaagagaaaaaaattttaactccaagtaaaaataggattggtgttctagactgaaaacgtgatcatgtacatgcattcagctgtttttatctttatccagacataatttatccgtgaaccttctcatggcctagaatgagacaaaaacaaacaaaagaaaacaacaacaacaaaatgaagaacaaagacacataaaaaaaacccctgctttctaaaaactaaaatcaattaaaaagaaaaagaaaattctagccctcaaatgactgaagggaccccctcttggctaacgggaccccagggaaaccctggaagctaagttcatggccatgatgggatggggggtgggacacacctcgttgtaccccttcctcactaaccactatcagcctttcttccctaaggggcaaacagaaactgacccttttgaaagactccacattgataatgttgattaatgacttatcttcccaggacagaacaaagctaaaatgagatcagtcattccttcactcctctctgggatgtctgctccctccattcccttttttttcaaatgttcaccttatcttatgtaaaaagtaaacttacagggcactaattaaagtctcgcaagtatgtaatcattcctctcactgttgcctcctcttttttaaggaaaatgtataaatactaaacctcctaagaacctctgggaaaaacagccaaacaggcatccataacttgtcctcaagctggctcaacaagcttcagtgattgagatttatgtctcaatcactcattttggttgtcacagtcaccaagtccacataaaaaaacacatgcatcttatctgttgatgttccctcgagcattcactcagagtctattaatttttatattaagcatgacttgaacatgcttgatggtctgttttcccactattagcaacagcaattggatgagaagaaaaatgctacaagcaagcaaaaaaaaaaaaacagagcaagttagttagacagtaagaggtatgagggatagtaaaaagcaactccaataaatatgaaaatatttggggcaatttagtctaaggccaaaagactcaggtacctcaagtatcccatatatatatgtatgtgtgtgtatatatatgtgtgtatatatatatacttacacacacgcatatatatgcatgtatacatgtgtatgcacacacatatatgcacatgcatatattcattaaaatgccattgagttgtgtgttttcacttccataagcctgtttctgagggtgaggaaactgggcatgggagaagagaacactagacgatgggcatgggcaggagagctggcatgccttgggtcaccgaggatttttctgaaggctattttctttactcttaagaagttcaaagtagatgatctgtaagacttctcctagctacaaaatgattgaagtctggaaataatcatcagcattcagaaggaggtaagtttccacactaggtcaaagagccaattccctgttacagacaaatagatgaagctattaaattaaataaaaccaggccaggctcggtggctcacgccagtaatctcagcactttgggaggccaacacaggaggatgacttgagctcaggagtttgagaccagcttgggcaacatggcaaaactctatctcttaaaaaaaaatatgaaaatgaactgggcatggtggcaagcacctgtgatcccagctacccaggaggctgaagtgagaggatctcttgagcctggaaggtcaaggctgcagtgagctgtggtcctgccactgcactccagcttgcgctacagaatgagactctgtctcaaaaataaataaaataaaataatcaaacaagaccttatacaaatgtatttgcttccaattgtcagcacattttagtttcaatgcaagacgtagttattaaaagcatgcatttaggccggttagacctgagtttgaatcctgactgtactacttacaagccatctgaacaggtgagttaatttaacactcaaagattcggttatctcatctgtaaaatggagataatcataaattgtatacatcttatcaagggtgagaattagtgaaacaatgctaattaaatgcttactatgatgccaccaccaacaccatcatcatcatcatcatcaacataattttcttccttcatcgttgtactaggaagatacggatcctttttcttttataattcagccggcaaagatgctgtagttaagtgcaaatatttgttagacgcaataaattgtcaagcaataagtagtcagagatgcctatacataagctctgtctttgatttcctgtaaaaaactgagttcatgttggcccctgcaagacaggagatttgatttgaagaaatgtcaggggaaatatttgtgcatataagcaaaggctatgtaagctatgaaaaaaatcatatttagaaagggaaatgagatggcattcacttttaacaaaatgaaaacgtctttgctgtcatcttttcttgacaaatttgcctcttgaagttatttagattaaaaattaaattaaattgagtgctgtttgcaagacttaattttttaatgcaaactgattcactatgcgtgataaaagtaaaagttaaacaagtgtattttacaaagtaattttgagaatatgtattgctgaactcattcaaaactttttatgcttctgttacagaaccctccatatttcattaactagtaaaactatctgttttcccttagatgtaaacttctggaggaaaaaattcttaccttactcatctttgcattgttaatatataaagtgtctggtccataatggaggctcactttaaaaagagaagaggggattgatgtatttttgtttaaggcatatgtttgcattttctgagagcctcaaaacaaaagtggaagttaatttaagatttggtcttgagatgtttgatatgtttttttctttgtatgtaacttttgtgaaaaatacattatcagcatcagaaatagtgacacagagtagctcagcgtagggcaggttaaaacactcttatccctcttattttttctgctctatctaatgcagatactccagcttacttgttagaggaatttcttcctttatgctctatctaatgcagagatacttcagcttacttgttagaggaatttcttcctttaatgcaagagagtaaatcagtggctgttgatgaggctgtcttcttgcttgtagatgtgacactcaagttcattgccatgtgtaagccctcaagatgaaaggcactattgaacttcaacaccctgctcttttctcaggaattcataattagcatttcctttggaatagtttagatgtcacttcaagcttgtgatgtatttcaaaaaggctcaggttaaacagttcccgcccgaacacttggcggaatgaaagaaggagcatattacacaggtccatcttctttgaagagagttactaattattcaagaggggctgccagacagggctcccacatattgatgaaaacaaaatcactgccttgaaacctttccagttctctaatgttctaaacaattatgggagtttaattaaattaacttgtagctatatttgccggaactttaccacaatatcattattattgatttcattaagccaatcgctttacagagacaccatgactgtaggcaaaacatttgttatgaagtaaagctaaaacgttttgtactctgtaattctgaaaaagaaatgaatcaatcaaaatttcagaagaagttttccaactctgccttacaaccaccattaagcacaggcatttggagatataaatgggagactaagtgggcagattgaatggcttttttctatgtgcacatactttcaaattatggtgtgtactgtcattttaagtgctagctatgaaaatgggagaaatgatcactgaagcgcttcttggatttcttgggcagttaggtggtggcaggttttcataatttaaattcgcctataactctttttacttcagaaagcctttcgaatgcagaaaatcatttacacttctgaattcatcagtgaaaacagagaaagtagagtcagtctctaatgaaagttaaattaagaataatgagattaaaatttgcaagacaaactgttttctgctgtaataattcaattaaagctgcttctaattgatatgatttttccccatgttatagtttattgcagtcagtatcttaactcagaattaattactcttttcatattaaaaaactgccattttcatgaataatcgactaaaaatagaaactagtaaaatcttattgcatgtaaatctgtcctagtttaacttaaatatagatttatttatttaaaaaacagtaactcagtgaggcatggtggctcatgcctataatcccagcacttgggaagccgaggccaacggatcacctgaggtccggagtttgagaccagcctggccaacatggcgaaattctgtctctactaaaaatacaaaaaaattagtcatgtgtggtggcaggtgcctgtagtcccagctaatcaggagtctgaggcaggagaatcccttgaacctgggaggcggaggttgcagtgagccgagatcgcgcaactgaactccagcctgggtgacagagcgagactccgtctccaaaaaaaaaaaaaaaaaaaaaaaccaacaccaccaccacacacacacacacacacacacacacacacgataacataactcatttgaaagcttagaagcttagaaacttagaaattttatccttttgtgattttgcagaaataaagtagaggttttttttctaatttatagacgtttctgcttttttttttttaaataaatcatttctctcattcatctcaaggaatataacctccactgaaaataaataaacagataaataaacaattatgctcactgtgtttgttgggattacttgggttgacagaatcccaaattcaattgtcatgaacaaagaaatgtgttgtaagtactgtgggatgtcttctggaactcgaagacgggcacataagtgggtctcataagcagcccgcctttagggcatgcttactgccccctccactctgctccttgtggtgagcccactttttcttctcggcctagagtcctctcttagttcttcaatgcacagaacagcaaaaatggctgcccttactgcttgagttttacagtttgtgaaattaaataattccaatttaaagctgttggaactttaaattatttgagctttgagaaaaatgtgactatatggcctgagcacatagcatgcagctgcaattcctgcttctccgattacagattacagtatgttactcttgtgctgtggatgattaggaaaggctgaaaggtgccataaataagagtctattactcctccttataaaatgtcgaatcagtcttccttggaatgtagtaaactataactaatcaaactcctgtaacataatctaagaattggtcttgcatgaaaaatgttgcaactctgttaacatttctgtctctacctatataagtgaaaccttacctccacacttggatgcactaaccccattcttttggagtctgtgttacccaggtggtgacagcctcaaacgttgtgctcaaataaattctacacttaatcatattttctgaatctcattatttaatgctgacaagtttatatgaacccaaggagaaattccttctctaatttccatacctgaattttggggcaaaaactttgatttataacactggaggtggagttggaaggggtgctgggcagagaaactaaaggcattcgttatcaccttattcaatataaaaacccattgaacgatacatggataaagttatatagcagaaaaaagtgtaagaaaagcagtctcaaaaaaataagagtgggtggttgctgaataatgagaaagagcccaagggccaggtgcggtggctcacacctgtaatcccagcactttgggatgccgaggcgggtggatcacaaggtcaggagtttgagaccaacatggtgaaagcttggccaacatggtgaaagccggtctctactaaaaatacaaaaagtagctgggcgtagtgacgcgcgcctgtaatcccagctatcgggaggctgaggcagaagaatcgcttgaacccgggaggcagaggctgcagtgagccgagaacacaccactgcactccagccagggcgacagagcgagactccgtctcaaaaaaaaaaaaaaaaaaaagcgccaaagaaagacaaaaattgatgcagaaaagaacgttggacagacaagtcaaacaactgaatgagatttcacagctatgaaagacagaaagacggaagtagcatgaccaaataggccaagtggttaattacattgcactcttcggcatggtaagtatttgccccgaggtagaaaataccaacgatgctaaatgtatgtgaaagagtaacttaggtttccagatttcttttttgttcctaggaggtatcacttctttaactctcaaaaggagcctcgtggctaatttttattgcagtcaaagttcaaataggagagttgtcaatgtcccctgaactatttgggaaagacttcatgggaaaagtaagattaagctgatcctagagggtaggcaggatagagagctataaaggaaaggaggaggcagagcacacgaatactttaatcaattgcttcatcttcggcgtcaagatgggaatgagtaagactcctgcacagaataatgaattctgtcagaatccttctccttctgcctctccaacttgacaattttaacctttctggaaggtgtctctgtagtcattttcaaacacaattccacctttgctatcaacttagttcacatactgcctgcttgaaattctctcttatacgaactccttacctcctgatcccacttgagctcacatcagttcgctcaagtagcaaaccccagaattaacctgggaacaagtttaaatatttcatctcttgtttaaaacttccattggcctgacaaccccatgaattttctgtaagcgaaatgaccacccaaatttatccacgatatgacgcccaactgtcattctagcgttataacttgcttcccacatgctcagcaattgctcctgcctgcctcaccttctcacatacacttcctcatgccagctgcgcccttcccttttccatctgtgcctgtggaaattcagctatacttctaggatcattccaaattgtaatttcctactgacgtccgtctttatccctccccctacctctctcatcccaacagaatatgatcatattctctgttaaactacttgagatctttatttttagtttaaattttttttaccctaccttactttacatgacttacatgtaagttatttattaacataaatatcattctctttagattataaaagctttggtaatttgcattagttttgctatctgtggcatggtccatgaggaattatcaccccccattttttactttacatacttctttgctgtgtttgtatgttcaccaacaggacgtattacttttataattaatattattttctatttgaaataattaagaattctggccgggcgcagtggctcacacctgtaattccagcactttgggaggctgaggcaggtggatcgccttagttcaggaatttgagaccagcctgacgaacatggtgaaaccgtctctctactaaaaatacaaaaattagccgggcttagtgttgggtgcctgtaatcccagctactcaggaggctgaggcaggagaatcgcttgaacccaggaggcagaggttgcagtgagccgagattatgccactgcactccagtctgggcaacaagagctaaactccatctcaaaaaaataataataataataattaagaattcccactttaatagtattaaaatattaaacgttaagttctttattcaaatgtctgttgtaacacatttgagggttaaatatcgccaactgctctttacaatatactctctgtaaacattctgtataattgctattgactttcaacaactaaactagtctacctccaaattatctctttttacaaccttttaaattcagagttaatgaacgaaattgtttacattcccttttttcttagtcacatctccaataaccctggaagtccgaatcaatagtcttatcatcggccccctttcagatggagagaccacagttcctgacagatgaaaggcttctcttgggactttttttaattgacgcaggtgcttgatttcagacaagcccttctattctagcttctggaatcaacttgaaattcagcaacctctatgtgtaacaaaaatggacgaatcattcctctaaaaaataaatgaacaatgatatttagcaaacaaaatacctaaagacaaccattgatttggatgagtgaaaaaggcagagaatgcagaagatgcctgggatttagctaatctctgagattccggcaggaaggacataaaaaaagtcaaagggctcttggctgagtttgccattttattttattatttcatttttattttattttattttattttattttattattgagacagggtctcactcactctttttttttttttgagacagagtctcactctattgcccaggctggagtatgatggtgcgatcttggctcactgcagcctccacctcccaggttcaagtgattctcctgtctcagcctctcaaatagcttacaagtgcccgccatcatgcccagctaatttttgtatttttagtagagatggggtttcaccatgttatccaggctggtctcaaattcctgacctcaagtgatccacccgccccagcctcccaaagctctgggattatgggagtgagccaccgtgcttggccaagcttgccattttaaaacattcttactaaaggaaaggggtctcacaatacctccacggagtataatagatttaaaatagctttggaacataagaattactctaatgtttcaattctttgatttaaatcccagcttctctttgtagccatttatgtctttgttgtttataaattcatacaaatatttcggaagccacttaagtttcccacctccttgggtaataaattctgtatgtaaattatctgctagttgaattcatatctagttcctattatttaattcttgcctcattcaagctcaaaagaagccccaccattttacagtatgagaatttagtgactaacaccttgtttatcctattcatggtattcgtacatccataaatgttgatccacactatctcctcctccttttcgtgagcaacagacccagtcattctcatagttctgtatggagcacatccttctacaattgtctgccccgcttgatatttgtgagggaaacctggccgaggccagataccatggttcatgtaatctcagtgctttggaaagctgagggagaaggattgcttgaggccaggagtttgagaccagcctggacaacatagcaagaccccccctctctacaagtaaaaaaaaaaatgaaaagacaagtgtaaaaacaatccagtctattgatggccactgggcatcacagactcgtttccagatattctccctccaacaccttcacacaactccaggactgatggtgggaagaacagccttatgcatgcttacttccatcctaatcctacactgcaaaccaggaaataagactgaatgtgcactgtggactaaaagcatctctgttattcccataaactgactgaaaacaataaatgtacccattgttgaaaataaggctctgtcatcatgtgttcagtgacgcagagcctagaacatttcagagtatcatgtaggtgattcttctctcaattctttcaaggctggtacaggactagtggcattccaaacacataggagagaagtttatttattacacacaatagatgcctcaggtcattcgagcttaatattcttatgaaacctgggcaggacctgtcagagtatgaaatgctccatctgaagccacaagagaaagcactactctgcttccactgagatgaaacatgaggactttggattaagtgtaggcagaagggctaaaaatatatatttttaatgatgtgatatcaagaaatgttacttaagtaatttatttttatggtaacatacttataaaatgcagcccagagatgtctctgggatggtcttagtagagttcttccaagagtaattaaagggatgacctcacagccatcaccaccgtatatatgatagtgctttgcctgggtccatccagctggcttagtccatgaaacaataccatgtttctaactaccattttcaaaatgaaattaaaaagggattataacctgaaggtagggcaaaagcactttaaaaggacaaaagcatcctcatgccaatgaagaagatttatttcaggtgtacacactaaaactaaatataagtatggtgatttatttgtcttaggtgtttcatggttttcaaagttttaaagtggtttctgcagctgctgaatctgacctttttctctgtgtaacactcttggtttacttattttgtacaacgatttttaaatttccagttcctagaattcttttaagatcaatgagtaaactgtagaagggcaaaaggaaaagatttctactttaattgtacccttgctagtgttgccgattcaaggcactacaacgttaagatggattttatttttcagaagtatttgaacagtgatgtcgatctttctaacccaccgaacaattagttttaaagcagagaaaattcaatgtgacttttctgacttgccttttatatggggatttggaaaaaacacctccttctggctagtccatctatgaaagaaggttctgcacaggacctagtttcaactactccttcattccacactgttctcaagagagaaattaggatgaatggtggacgaattcatacaaaatcccaaggcaaagtaggtccaagccttggcacacaaacatataacttctagtccaataactggctcttttatatccaccacaattttgttttccccacgagtgccaagaaaatcagaatgtctagttgccttcttcctgacaacgattctcaatgatcctatgaagaaatgaataaaaaataaaaaggtacctcacttattactagatatctgtgactattatcttatggctagaacacgaacatcagaaggtcatggcagtgatgttgaattatttaaaactatttccccatttggtaattgttaaagtcatagagacacctaggtagtttgaaatgccctccattgaaagccagcaatttctatgtgtctccaccagccaagaggaccctgtagagctttactttctatagctggaataatgaaaaacaataggttttttattgttttaaagaaaaaattaaaatactgactatatttttaaaactgcacctgctcccttaacgttttgatactcgcatggataaacaactttgataacctctggtgtaaagaacgtggcctttgttgcttagcagagccatgtgcaaatctcaggtccgtcatttgatgaatgatgttaggaaaataatttagcctctctgggctaggtctttgtactccttccctataaaatgagaatgctacttccttgataaaacatgtactttacagcataagttccccttccttctttctgtgcaaactctgagatgacgctatttctaagagtgcaacacttggaaatgaggtgtcttcttttctctggagctattaagactttctttattccctacttatgacacactctgtattacattatagtcatatgtgtacatgtcttatttcttttgttctcttttactgaaagtttcttcaggataaatattagtttaattacactggtttaatcactgtatcctgaatagtatcttttgggaaactgagtatacagagacaatggctagaccacatatgagcacagaattctgacccacagcccctgcaaccagcctgggaagccaaaccacaagctcagcagtagtaagtccaaaatggtcaagactcaggcaatgacaaccagcttccctaatttttgcctctgcctataactctggacaaaccagagaaagctagacactcctcaatctagttatattagatacccactttcagcttccccatgcaacaacctccagtcagagctcgctctttctctctctctctctttctctctctttttattataaagctttcccactcctctgcctgcctttgagtctttgccagacacaagtggtggtggacgattaccttgctacagcaagtgctgaatacatagcctttctttgttttcattttggtgaccttcatttacttccacattaaaaaaaaaattcatgtacatctcactgcattcccaagaagaatctggggtaaatccttgtccagaattatgtcttttatagaagcaaagtctccttccagttctaatattctgtgactaatagatgttgaggtcgaataaaatgctgatttgttgaacaacttttcagaaatagattattcctgtgtataagaattgtcaaaataagtaattcaaaatctaaactgttgaaactttcccttattttgagccctaaaagaatatgattatggggcctgagtcatgtgacaggcagctgtaacctaggcagctgtaacctttgtttttgtgattatagattagccttcttcctatattgttttgtaaaatgttgcaaatgactgaagggcaccagggaagaccctttccctctacgctgctgatcttcattacagattgactttcttctttcctttctcacacaaggactttacttgactatcacattgtctaagatggaatgccaaacatacttttaaattggaaaggaaatgaaaacaagctttacagaaaagaaaacaaactgtaaccaatcattacattgctgtaacccataaaccagccttgtatagaaaatgctgtaatcctgttaaatttgttttctgcttacataagcaagaccttaactttttacttctgagcactgaccccatttctctggagtctattttctgatggccattcccacctttgcactggaataaactctttaaaactagatctgatccttgcagttatttcaggttgacagaatggttcatgctgaacctccgaattaagttgttggtttaaatttttatgcaagttctaaaagaccaaattaacctcccaccacatcatacccagcaatattatactgcccagttaagagccatgggtataaaattacatgatttctttcaggaggcatttatccttctactaaatatcagttcattttttcaaaaatccactcgtccagctttgtgggaactgaacactaagaattctcaataggggaagaaacaattgtctcccccattgtatgtgtattgatttgtaacataacgtggggcgaatggtttgagcctggcttctccttctcttcttgccaaccctggtcccttgttttgggatccgtttcccttggagaatataaacattctttatcccacttcttgaaaggccatccttgtctttctagttgatgttaggaatgaactgacatggacgacaatgactatgacctatgtaggaaatctgtgaactgagtaagtagtcatatgaaaccaaatcttatgtgacctattgatatggtttagatttgtgtccccactcaaatctcatgtcgaactggaggaggggcctggtgggaggtgattggatcatgggaagggatttcccccttgctgttcttatgttaatgagtgagttgtcgcaatatctcatggattaaaagtgtgtggcacttcctccaacactctcgctctctcttgccaccacgtgtgcttcctctttgccttctgccatgactgtaactttcctgaggcctcccagtcatacttcctgttaagcctgtggaactgtgagtcaactaaatctcttttcttcataaattacccagtcgcaggtagttctttatagcagtatgagaatggactaatacacctatatttacactactctaaaacttgcattatacatgtaattttagaaatttttattgtggaaaatcttaaacagatacaaaaataaatagaatacagtgagccacaggtactcatcacccacctgtaaaaatcttcagtttattatgccaatttatgttttaaaaggaataccaactctctctatgaaaagtatgacttaggaaaaggtaccgtatataggtttttctattagtgtgaatttcccatgcataaagtggttgctctctcctagcaggctctggctgctggcttcccggcctcccttaatgctgtggatacctgtgacacaagacctggctttccttaatgcctatctaacttctttatttcctataagactccaaacttatgaaaaaaagagggtgacagacaacagttcatatactaataaagtaaaatttgacctctatttttatatacattctgtaaattttttttagttgacatataataattgtacatagtcatggggtacatagtgatgtttcaatacatgtaatgtatagtgatcagggtaattagcatatccatcatctaaaacatttgtcagtttttttgtgttggaaatgttcagtatcctccttccagctatttgaaattatatgatatatgttattgttaactatagtcatctgacagtggtatagaacactgtaacttatttcttctaatacacattatttaatttactcctaaccaccatgtaatatagataatgcaatcatgttaatcattcctttttagagataagagagctagggttctgagaattaaaccgatagatgtaaggttacacagttggtaagaagggggccctctacgaggtagtatatgggggcacatttgcaaagcattacaatggaagattatatttcaaaaaaaacacggcaaaaatgcatgtcagctttcttttcaaataaaatataaatgtccttgaacacagtccactctcaggggaaatttgaggaaaagacatatcatactgactatattccatttgattgcacacagtgatacaatcctttacatttcaaccaagacattgaaatgctcctacttcaagttctgattgttcacatgcattctctgggaactgctgcctggatgtacaggattttttaaactatgcagaacctacatcattcattctatatggcagttgttgaaataaacgtttagtgattctaaatacctcactaaagtagctagtacttattgtgaatctaccatgtagaagtgctgaatgcctgttgtggattgtggatggtgacaggaaaggaggtaagaaatgacttcctctgggagggatctttgatttgtgctttgaacactgagtgcaaatcagataaactgagtggagggacttaagcagaactgcagcaatgagaaaactcctggttaatttgacaggaaaagattgtttgcagagcggtatctgtgggataaagtggaagagtgtaatgtacaggcttgagtggaaatagaacatggataacaaagaagaaacaaccctaggaaaaagtaaagctgcaatatatttcttatcggattaatctaagatcagtgtggagaagccaacagagacataaaggacctcgtgtaagaaatcagacaatggcactggggacaatagccggtaatgcagagaatcaagcaagataagcatgaagtcagaatccaggcataggctggactaacacaatccttacctgcaaaatctgtaaaacttttgatagcaatctgcactaaaataaacatttttcatcatgacccagcacatacatgtgtattccaacatacatagatttaattgaaacaaaagttttacaaaacaatagctattctttctatggtagtgaagcctactatttttattctattccactgaataaaaattaaaatagattttacaaccttcttaaatgtttttacaacccacaactggaacatgattcaaccagcagttcataagagactattgggtacattccatgaggaaataaacatacgcaagaagtttccatccttaaacaagtttccacccaattaaacaattaaacaaaccaaccaatcacagtcctcctctggcaaccatcttatctcattttatttaatgccaaacctcttgccttccgcaaagagctgtctaacctcatagttttaaaactttttcgtctcaggacaactttacacttttaaaaattattgagaatcccaaagagattttttttaaaaaatcaaataggctgtacctattaatatttaccaattttgactaaaaacaaaactatcatttgaccctgcaatcctactactgggtatttacccaaggaaatcattttataatataaaaaagacacttgcactcataggttcatcacagcactatttacaatagcaaagtcatggaactaacttaaatgttcatcaacagttgacagaataaagaaaacatggtatataaacaccatggaatactacacagtcttaaaaaagaatgaaattatgtccttcccagcaacatggaggagagggggccattatcctaagtgaactaacttagaaacagaaaaccaaataccttttgttctcacttataagtgagagcacaacaatgggtacacatagacataaagatgaaaatataatagatactgaggactccaaaaggaggcaaggaggctgagggttgaaaaattaccagttgaatacaataatcactctttgagccacgggtatactagaagcctactttcatcagtatgcaatatacccatttaacaaacatgcacatgctcccctgctcacccaaaatgtaaaataaaataaaacaaaacaattaaaaattaaaaatttaccagctatgaaataaaaaattaaaataatcagtaaaaatatatattaattacttcattaaaatgataataataagtacattacatggtaacatgaatatctatcacaactaactatatttctcaaaacatatttggtaagaggaatgacgttattttacagttttgcaagtctcttccatgtttggcttggaagacagctggattttcacatctatttctgcattcaatcagttgcaatatgttgttttagttgaagaaaatccatccttgcacagaaaatgctttgaataggaagggatttttagtagccttatcaaacaatgaatgatactcttctctgctactataccaaaactccacaggtagtagtcagtgattacctgagatgtagaatctgaaacttttaacaatgaacttttcatactcctactgtactaaaattcattctcctattttggactttgaatggatctttttacccaggaatggcatgtactgatgacttggaaaatactgatgcactgagttatgcagatctcttaaatgctgacacaattcatcatacaatatccaaaatgacatttgttaatatcaccactgatacaatgagaaaagccttttactattggaaagctcccaggctcatcgtgacaatcacaagttttccaaaattataactttcactcacaagtttgttattggcaactaatactgtcagttgttttccttgaaatgacggtcttatttttttccattaaaaaaaggtgtgccaaatattcatgtctgaaacagcagagcttgtctttcagttattctttcaagtaacaatgactagctcagtttgcaactcaaataatagcacatcacacttttgtatgcagcgccttgatctcttcaaagccatcttccacactgtggtccgagtggcgtgttgtaagtaaatctcctcatttttctctcttattgaaaatacattggttttctcttttgactttaggataaagctcaaagtacttggcatattatgaggccctgcccatcctcaatgcaatccccatccttcccacactggagtttttaatcattttcccaggtgagccatcctcaggcctctaaggcattgcctgcctacctggttaaaatgggcttaccttccaagattctgctcaagttcaggggctttgagaagccttttctcatacaccttgctctctacataccactatcatcataggtctacttatcaattaatgttgtatttgtaattttttttgttttgttttagagacagggtcttgctctgttgcccaggctggagtgcagtggcactatcacagttcactaccgcctggaactccagggttcaagcaatcttcacgcctcagcctctcaagtagctgggactacagatctgcaccaccacgcctggctaatttttatctgttgtagagatggagtcttgctatgttgcccaagctggtctcgaactcctggactcaggtggtccacctgtctcatcttcccaaagtgtgggaattacaggcatgagccaccgcgcctggcctaaactgtgaaattcttacagggggaaattttgtactgtacagagatctttttaccagtacacatatgtgtccaaaatgatctcaggcctagaaaagccacggcctctagatagagaggaaaatagggaaactagctgacaagtaaagggtcactcctgatagcacagcagcaggctatggagtttggtgtccacagtttaagaaatggaggatagagggtttagagtggaggtgcacgagtgaggtgcattttaaataggttaagtaagcctgcttcacactacaatttgaactttggagaaagactcaaggcgaggacaccgtacctatatttagaccccagaagaaagctttgctccaggtctaacaggttatctctccatgagatagcctccacttctctctggattatgatctcacttactccttactccattactccccttgcctgggctcctgactctgaagattgcttcacagatttcaacagtaaatagatgatatcaggaaaaagaattcagaggccaaattgtaaaatattgggtgaaaaaaagtactggacagatgtcaaaaacctttcagagattttacttttctaacttgctccaaatatctctaaaaaggaattatggtttgcagtgcttccaaaagagcatagctgcagaaccttgttttgcaggagaatttcaagggctaaggtttagtgcaatacacctgggagagaccttgaggtatgtatgcatctaggttgagcgatgaaaggacaacaaaaggaaaagaaacaaaaacaaagtctctaaagagcagcaacaataaaatcatcacttgaaaacttgtttgaatatgtatgttataattgatgcagcctcacataaaaggtgacaagctatggttccaggataatatgtctgggagtgagggtggatgacagagagggttgtttggaagcttataggagaatatactgctctaaatttcttatcatgataaacttggaactttgaagtttagagaagaaagagtttatatatatgctagtctatccacctgtgttgcaattgttctttttttttttttttttttttttttgagacagggtttcactctggtacccagtctagagtacagtggcaagaccatggcttactgcagcctcaacctcctagctcaagcagattctcctccctagtagctgggacctcaggtgcgtgataccacacctggctaacttttaaattttttgtagagatgaggtctttgctgtgcaggctggtttcaaattcccgagcttacgcatttctcccgtcttagcctcccaaaatgctgggattacaggcatgagccactgtgcccaggcttaattctttttctgaaggtaattattaagttcttttccaagactgctttattacttttttgaaaaatcacttatacattgcttttgttatgcaaatgcagctgctatcttcagtgacattgttcagtaagttcacgcaaaagtaattcaacccttggcacttcattcatcctgttggcaagctgaaggagtagagagtgaaaaattaaatgaatatgtgatctgtagttagtacctataccttctatttagcattctcgttactctccccaatctggatgcctagtgtgtaccacagataccacagggttatgtcctgataaactcatcataagttgaaaatattgtaagtaaaaatgcatttaatacacctaactgtctgggcatggtgtctgatgcctgtaatcccagaactttgggatgctcaagctggtggatcacctgagatcaggggtttgagaccagcttgactaacatggtgaaaccccatctctactaaatataaaaaattagccaggcacggtggtgcatgcctgtaaccctagctacttgggaggctgacgcaggagaatcacttgaaccccgagaggcagagattgcagtgagctgagatcgcgccattgcactccagcctggccagcaagagagaaactccatcacaaaaagaaaaaaaaaaaaaaaacacctaacctaccgaacatcatagcttagtctagtcttaccttaactgtgctcagagcacttacattggcctacagtttgacaaaagaatctaagacaaagcctattttataataaagtgttgaatgtcccacttgatttgttgactcctatgctgaaagtgaaaaacacagtgatcatatgggtagtcaaaatacggtttctactgaatgtgtatctctttcacaccacggtatagttgaaaaatcctaagtcgaaccacattaagttggggaccatctgtaaacataggtgcttgataagtgattgtcagacacatgaataaatgagggaaatttcctgctcttgtgcaatcacagagacctctggaattcaacatagctactctcacaagtgctcaggaaccctagaggacatcaacaggggtggtgtcaatcagggctttttgatgacttgccccagagcctgccctgctgcagaccccaggtccttagcctcagcaacacccttggctctgaggacttcagtgtggctggaccagcagctccctctttttcatcactcattcattatttaatcagcctatctacctcaccaaggcctccccaacccagctgctcctttctgtccataaaataactgccttagttcaggcagttatggctgggtgaagcagagacaatgccactattcccaccattctaattatgacccacatcctggcaagtggattctccctaagatacaatcactcaaaggctcaggggcaagaaaagagaacatgggccggacacggtggctcacgcctgtaatcccagcactttgggatgccaaggcgggtggatcacctgaggtcgggagtttgagaccagcctgaccaacatggagaaaccccgtctctactaaaaatacaaaaattagccagctgtggtggcacatgcctgtaatcacagctactcgggaggctgaaggaggagaatcacttgaacccgggaggcggaggtggtggtgagctgagattgcaccattgcactccagcctgagcaacgagagtgaaactccatttcaaaaaaagaaaagaaaagagaacatggctttaggttttggtatcaaataagcccagaataatgctcaacccagaatgatgcagacctatgtcctagtcatggtagcatgggactgggtatccccgccatgctgtccaccctcaccttagaagagggcctgcccctggagaagcaggagaatgtgttccctttggcgaaagtttgaccaaaagaggaagaaaaatgaaccaaacatactcagatatttttctgaaagttactgatgaaatgaatcactccaatttcttaggtcaagcattaataaaggggtggggaaaagccagggatgtgcttagagagtatccctcttaagaagaaccaggatgggcatggtagctcaagcctctaattccagctctttgggaggccgaggcgggaggactgcttgagaccaggagttcaagatcagcctgggcaacattagtgagacctcgtctctagaaaaaaaaaaaaaattagccagacatagtgctgcacgcctatagtcccagctacctgggaggctaaagtgggaggatcgcttgagcccaggaggttgaggctgcagtgaactccattgcaccactgcactccagcctgggtgacagagagagaccctgtctctttgaaaaaaataaaaaagaaagaaaacaagaaccagaaaatgcatttttgttttcttctatcaagctttataaaagcattggtcaacagatggaagagtggttttgaggatagccctattccctcttaaggctgggatagagggttagggatggcattcaaaggaaaacgtctacctttagtacaaggcggttctattaaaactgtggaggcattagatggaagccagcagtaatgctttagaaccattctgggcttcctgcagagtggtgtctgctgggacctgaatcgtggcaggagatgcccagtgcacggggcccatttggtcaccagcagaaacaggaagggccccctgggagctgagccaattgtgtggacatgtgagacatatctcgggacctcccaggagagctatggaagtagtgataggacactgtaggcgctgcaggtaggcagaggcaaaagccagcgaacttgttactcatcaatggattctctctgtactaactgctgaggcctgaagaaacttggttatatacagaagtgtgaggcctcccttggagactaaagcatttgctccctcccaagacattaggcagaaaatactacttgggatggcaggttgttttgcacggtcatgcccttttacttcatgagctataatctagatgtcagctggggactctgtgtcctcatggtatatgtaggattgctttgaccctcccattggacagtgtgaagaagtcttaagccaactggagatttgtggtcattcttttcatggcttagctctatccacacaggcggtcattttctgggcctgcaccatgcagagtccaaactcagttcttccaccagtctccataacaatgctactcgctctaagcattttatgaggtttcctagaattcatgtaatatttaaggggataacaatgagagggctatatctcactgcacagtattccaatttctctaggtctttgaccctttttcctccaatcatctagatacccgacatgcacaaagacatggacacacacacacacacacacacacacacgctgaattcatcctccctttgatccacagaaaaccaagggttcctcctctgctctcccacagaacagcatccctcccactcagctttcagcttctatcctaaatatgctctgcaaggaatttgcccaacaaaggcacttctctagttagaaaaaaattatcatgccagttgctaaaacaaaaaaaacactctctttttctaaactaatttagatgcatagtaggtgcttagaaaataataagtgtgtaaatatttattactctaagtaaggtcctcttcagggtgaccctgtacagaagcagcctggggctgagatactccctatctaatttataaaggatcagggcaggcatacattaaatccttttttctacctcgatcttatttcctcttaggaactgaaagtgctttcagacattatttcagtaatccttgcagcttcccccaatgagaggaaaaaatgcccttatctccagtgcgcagatggagcccagagagatggaagttaagtgactcccaaggttgcccacagggagcacagagaagaagctaagctgcgacctggagtcttggtgaccccgttctagagttagaagataacgttgccttacaaagagttttcaaatgtggcagcttttgctctttgaaatgggaataattgaggtttcccatttatatttatttatttatttattattattattattattttgaggcagagtttcgctcttgttgccaggctggagtgcagtggtgcaatctcggctcaatgcaacctccgcctcccgggttcaaggaattctcctgcctcagcctcctgagtagctgggattacaggcatgcgcaaccacacccggctaattttgtatttttagtagagatggggtttctccatgttggttaggctggtctcgaactcccgacctcaggtgatccgcccgccttggcctcccaaagtgctgggattacaggtacaagccacagtgcctggccccatttatattttttgctctgtaatggggcatgggagttcatgcaacgggctctagatcaagcctgcttgggtcaaatgcgcagctctgctactctctagttactgaccttgggaaagttactcagcattttgttgcctcagcttcagcatctgaaaaacagatgtgctaaatacaacaatatccttctcacggagttattatgaggatcaaatgagtttacccctcctacctccagccccccatacacccactagagaggttaggaaagtgcccggtacagagaaatgctacataaatgttagctataattatttctccttttcgaattgtgcattctttatttagcaaccttaagttgattttttttttttttggtctaggtgacagcattgcctaactatagaaaccaaccttgtagagtcctaggcatataattaaacctaatatatcaccatactattgttcacttctttctttccttccttccttcattccagaaacactttccaagtgcccactatgtgaaaggtacggtattagattaggtacagtagtaaaggtaatttagaagataaatttggccttagcatcttatggtctaaggagaatatgcacataaacatttaaatttcaactcaatgtcaaggtaatatcatagagagaatccagaagaagcaacatctaattctgcttgatactatcaggaaagccttacctgaggaggtaactgagtcttgaagtagaaataggagttattctgacaaataaaaaatccttgaaatgtttgggcaatttgttcagaatacatattttttaagctcacatacaacaatataaaaagtaaccatatattagtgataaagcacgtctcaacacattttaaggattgaagtcatacagaaagcacaattctatgaagctaagaataaattactaaatccgtcaataatccctactcgacagccatcattctcagcaaactatcgcaaggacaaaaaaccaaacaccgcatgttctcactcataggtgggaatcgaacaatgagaacacatggacacaggaaggggaacatcacacaccggggactgttgtggcgtggggggagcggggagggatagcgttaggagatatacctaatgctaaatgacgagttaatgggtgcagcacaccaacatggcacatgtatacatatgtaacaaacctgcacgttgtgcacatgtaccctaaaacttaaagtataataataataaaatttaaaaaaagaataactttccattttatcaattgaaattaatagaagtaaaagtttaaatagtgttgactacaaatattagtatatagatgtatgtatttgatgtaaaaacatagttttggagattattctcttcaaatgatttagtatatttcagaaagataagaggatgataaatttcaaccaaaaataataacactgagcttttaaaagtatacttgaaaaaaaagtacagttgcatagatttgaagaggaaatatagagcagtatgttatctaaaaagttcagaaaatgggtcgggtgtggtggctcacgcctgtaattccagcactttgggaggctgaggtgggtggatcacgaggtcaggagaccgagaccatcctgactaacatggtgaaaccccgtctccattaaaaatacaaaaaattagccgggcgtgtggcgggcgcctttagtcccagctactagggaggctgaggcaggagaatgacgtgaaccgggaaagtggaggttgcagtgagccgagattgcgccactgcactccagcctgggccacagagcaagactccgtctcaaaaaaaaaaaaaagttcaaaaaatggccaggtgcggtggctcacgcttgtaatcccagcactttgggaggccaaggcaggcagatcacttgacatcaggagtttgcgaccagcctggccaacatggtaaaaccctgtctctactaaaaatacaaaaatttacctggcatggtggcggtgcaagcatgtagtcctagctaccagggaggctgaggctcgagaaacgcttgaacccggggcggaggttacagtgagccgagattgtgccactgcactccagcctgggtaaaagaacgagactccgtctcaaaataaataaataaatttaaaaagttcagaaaatattttataatgtcaaaaatataaattacacagtatatgtatatatgtaaatatatacaaataatttacatctctataaaatatttcaaaattattttataaagcaacttcccagaaattgagtatttaaatgctatttggacatgcagaataataggcaaaaaaaaaaaaaaaaaaaaaactcttcagaggaataagtagggaatttcatacaaaggggtgataactcttaagatattttagctttggattaatttacatttccctaccccgtaatgatatgctcccttggggctagaaagaaagcaaattaaataccagttgaacaactaaattgattattatattgatatcccttcttcaaaatgttaacggaaggacaactactatttatacacaattagcatggaggagagacgtaattaaacataactttagataatttctccaaattatactcctctaacattttgaaaaagtttttaaaacagaagtgatataaaaacaggtgagcttcttaccctcagcctccatgctataagtaacactgaaattcaccataagattttcttgcaaaatgccataaatgaccttgcgtgtttaagtgtaccactgaggggatattggctactagaaacaaacaaacaaacaaaaaaaaaacggaactcaaaacacttcaagcagtaaaaggttttttgtttgtttttaaatttcacaaaatgaagtaaagtcccgaggcaggatgatttcagatttggttaagtcagattctttccgtattctgactctacattcatcagcatgggaccttcccagccacgacattatcacatttttacatgcctgtgcccaaaggcaaaaatagcgtcaacctcttacttttccttcctctaactagcaaaaaagcatcgccagcaccctcacagaagaaatctctttaggtcacaacagctagaattgcattaagtatattttataagccaataatcaccggcagagagaataaaacagacataatcaaccccctaaagagcagcagttctcaaacttgagtgagcaccacagttacttggagagtttattaaacgagatttctgggtggagcccagaaatcagtaggtatagggtggggcccacgagtctgtatttccaaaaaacttccaggtgttactgatgctgctggtccttctacaaaccccctgcactgccctaaagcacgtgggagcatcttagcaaaggggtgggggaggtggctcaggtaatcaaccaaagtgcatctgagatctaatattattttaaaattgcttttcaagaattcctattacttcaaattaaagatgtaactgagtgtcttctgagtattttagaattgcaaattttgatattctaccatcactatgctccacctctctgaagccattactagggcaaggatatagtgagaaagtttctgtcactgctaagcaagtgcatccttcagattgccaatgtgtcattgtagttggagctattaaacttctatgtggcatgaaaattgtttggctaactttaaaaaggagaaaaaaatggaagtggaggttagaatttttctagcccagcaagaacccacttggtaaccacttttagataaaaagcccaaaaataatatacttcaccagatgttcctttaattttccagggattaatttgagagtcaattacctattttaagtgattaacataaattaaaaaaaaaaaacactaggctctgaaccaatgcttttaactgtatgatggaccattgttcatttccgatacttttaagaactaggatgattttgacacattaaaaaatgtcctggaatgaatttgctattctgcttggcaacatttgaggaagtaaatactgctacaaatcctttaggtagctttcaattgtccatgtctgttagtgagaagagggacagtaagaaaaatgctaaggtcaaattcactcatgacttcatgccaaaaaaaaggtatttctgagttgataactctaaaatctttttctaagtagggacaagaattactaataacaaacagtggaaaacatactgaactaaaacacaaaatatctgaattttacaggtcatttaacttccctgagcattgctttcttatctgaacctctaaggattggatttggtgtttggtttcttttttatttttataacatccctttcagatataatccaaaggtgacatctcctttctctgtcctatccatctttgatgatatgtgttaataacagttaaatgcaaaataataggataaaaggcttaattacaaaaaaaaaaaaaaaaaaccaagaggccagataattctactctggaagaactggctgtaacatcatgatgatggcagcaatttagaaagccacattaactttgttacagagatttatttaacgccagtttgaagaatgacgtctttatgccgatgacatgattcatttttttttaatgagtaaaatgtgtttttctccattagactttactctctgtaccttgaaaataaaaatacctttccagtgtcatgcatgagtcatattgattctcaaattaaactaaacacccatagcacataggaaaaaaaagccaaatgacaatttagaaatgtaagggaatttgaatgtctactcatttacttgaatctaatcattaagatgaggatgttatttcactctttctagaacaatagttttccaacttgagtttgcatcagaatcaccaacaggaccagtaaaaacagacagctggacccaacttccagagttgccaagtcagtgggactatgtagggcctgaaaatttgcatttttaacaatttctcaggctacactggctgatgttgctggttgggaaccacactttgagaactactgtttgtagaagactggtaaaaattggtaggtgtaagaaagatattctttttagatatatgtctgggagctgggggcaaagtagaaaagcatttaaaaagcaaaaatgagagacacctgaactgtcatgcatttaccagaattttctctcataacgtggcagccttcactgtcctctttcctttttactattctaaatcaaaacattacaaatgtacaagctggaactgattatgcataatagctgatgttacttcactgattaaaaacaaaaaagcaataaactttggctccctctgcaagctgcccataataaaatgcagaggaaatatttattaatcaagcaaagactgaaagacatttcgttaatggtctgcctcatcacatcagtttgaatcacattacacatcccgttaagaagagatgatgcttaaaaatacagaaaactaaatgtggcattatcatccatcccaactggaaaatgtgatggattgtccttaatagaaagagtggtagtctattcatgtggtatgtctcgcaaaggaccgccaggctccaagagccaagtattctgatcactttttccttaatgagaggctcccataaacacaatttaatcctctttgaaaacctgagggctattttgtgtttaagtggcatacacagagatcattaaaatgtaaaagaactgtgcagggaggcccaatttttttccaggtggccatgcatcagaattttgttagaatgtaacatggatttgattgaatgattctcccatttccacatggagagtggagcccagagaattgtttaatcatgtatccatgattcaatattcatttatggagcacctatgctgggccagaggtactatgagtggggatgacaggatggatgtgacagacaggacccctgtccccatgcagtttacaggctatatcagtaattaacaagaactaaaatacttggcaaagaggaatgcttccatcaatgtttgtttaaattaaaggaaaaaaacaaaccccacaacgaaataatcaatacagttgtcacaagtgcacaggacagcatgaaagcccatgacacatattttggagaagaggtacttccattttttttggtgggggaggtacattagcctcaaatttcacagaatacatgcaatctcaaagttaaaaaatgggttttactgttaaggtctgtcaataattcaacttattatttgtttgtttgtttgtttgtttgtttgtttgtttgttttagacggagtctagctctgtcgcccaggctggagtgcagtggcacaatctcggctcactgcaagctctgcctcctgggttcacgccattctcctgcctcagcctcccaagtagctgggattacaggtgcccaccaccaagcccggctaattttttgtatttttagtagagatggggtttcaccgtgttagccaggatggtctcgatctcctgacctcgtaatccgcctgcctcagcctcccaaagtgctgggattacgggcctgagccactgcgcccggcaattcaacttattaatactagaatacattttctacagaaaaagttgtgaaaaattgtgatataattgtattgtagtacattgtaaaaattacaatacaagtgaaatgctttttatttacatttataaagaatagaaaatgtaatcataagaaataagagaaaaaccatttttacataaaattgaatataaacagcaataaatgaaatcgactatatatcaatttgataaaccacagagaaaaaaataattatttcaaataatttttgaaaatagttctttgacccattttaatgggatgtataagtctaagggcaaaaaaaaaagaaaaggtctgaaagcataccttaaatttattaatgggtttgttagtagtgatattctaattttgagacaatattgtagaaaactaaagagataggttgataatattagccaccataattttttttctaagggaaaggagatacaaatataaaaaaaaagaaaccaagaaaaagaacactcataatattaattttctcccacttaatttttctgtaatactaaatttgaattgaaaaatatagtgtgaaccaaagattataaacgtaatttcccttagggtttctactgaaagggtttagaaacattgacacagtagcaacaagcaaatttagttccctgatcctggtttctaaataccattccttacagaaacaacaaacaaacaaaaaacaaaccagttaataccaagtttaggtttggtcaaggtgaactggtgacaatttgttgtgccaaacactaatttaaatcaaactatgtgaaagaattcaaaaactagcttcaaaaagcattcatgagttcacaataagaaacagggagagagagaggcagagggagagaaagagagagagaaagggagacagagaatgaatgagatgccctccagcaaaggaaagcagtaagtccacgacatcatctatccttgccaaaatgtctatcctggatctaataaagcatcccatcctgcactgcccaatatggtagccattagccacatgtgactgtttagatttaaatttagaataatttaagttaaacaagttagaatttcttttcctctatcatcctagccctctcacatatggctggtggctactgtattgggtagcaccaacgaagaacagccatcctcacagcaagatctgtcgggcagtgctgctccagacctatcttccaaattatatggaaaccaagaaaccaagttaaatgacactacggggaaaccatatgacaaatccagactgacagaatgccgtgggacttctactagactattagcctgaactcttccaaaagtaaattgtgtttgtgtgtgtgtggtgtttgaacacctacatatgtatataaaatgcaattattattgtatactacaaagatgtaagagaggtaacaaccaaatgtaatgcgtgaatctggactgaatactgaattagaaggaaatctggagaaatctgagaatagaatggatattagatgactatccccacacctacgccatagaagcggaagtcactcttgttgtttataaaaggcccacgagggaaagtgccctactttttcccagagaggggaggggcttgcgggaaatgaatgggagagagttgaagcagagtgctgagaagagggaaagatttaccataactggaaaggaaaaggagttttactagttcctcactgaaagattgtccccggggcctgaaagcttgaagagatgagaaactcctcccctttcaggcccagtcccaaggcgcaaggccacttacagtaatcagcagcgtgggtcagcaagacagcggaagcaggacgacagccggccggaagacacctaccccggccggaagacacctaccctggccggaagacacctacctctgaagatggagaaggaggccgtccgggtactacgtagcagtcaggtcagtctgggacatttcctgtttacagaggactataaaacccctgtcctgtcctcatttggggctgacgccattttaggcatcagaccgcctgtgcccaggcgctcattaaaacagcatgttgcggccgggcgcggtggctcatgcctgtaatcccagcactttgggaagccaagacgggcagatcacgaggtcaggagatggagaccatcctggctaacacggtgaaaccctgtctctactaaaaatataaaataattagccggatgtagtggcgggcacctgtagtcccagctactcgggaggctgaggcaggagaatggcgtgaacccgggaggcggagcttgcagtgagccgagatcgcgcccctgcactccagcctgggcgacagagcgagactccgtctgaacaacaacaacaaaaaacaaaaaaagcagcatgttgctccacacggcctcgtgttgtctgttggcgtgctcttgggttcgagctgagaaccttacactcaccacttccgggatgcctcccctatctttttgcaactcttttttgagggaataatggcactgggtttacctagggagaaaggatactaaactctggggctcccaggtttggcaggctcttgtggaaaaaaacctgcccttgaaaaacccctaaccaaagagctttgaacaagatgatctgagtgggaactccttctcccacgtggtgtggccggcctcgtgtctattaaactctctactacaatgtcagtggcctttttttattatttttttttgagacagagttgcccaggctagagtgcaatggcgggatctcagctcaccacaacctccgcctcccgggttcaagcaattgtcctgcctcagccacctgaccagtagcctttctttatgcagtgacaggacgaatcccttgggtggttacatgataatgacaaaaaaaaaaaaaaaactagtttgttattctaagaaagacatatttgaaaaatgagaaaatttgttgactgtggacaataaaagacagtgttacaaacaatatatgagtctttttaagaggaaataaaatgtatcaaatcagatctatcgtccaccacatccctccttcactagccggtaggtgaagctctttcaagtgggtgagggtagatggtggaggaaagataagttttgttcaattaaaaaacatgtatagacagtctgcagtgtcagacactgtgctaagctcctcattacttcaggagcttgataaaaatactgatttcaaggcccagctcccagagattctgactgagtctttttctaaggtggggtccaggaatcctcatctttgaacattggtcttcaccctttccacaaggaatcacagtggagactttcattggatggcaccttgtgaaaacctgccctagtgttttggagataaggggggggatgttcatggggtagaggggagtgtcactctggagcactctcctgccttgtgtggccacagcacagtcccacagtgaggggccacgtggcactgcgcaccgatcttgagctatagtcacaaagctcctaggcaccacccacgaaaggccgggtgatggcagaacaaaaccatctggaaacctgaagatggctatcttctcttttgcagagaacaaagaagattacgtgttttgttcctaccttgatttcattttcagttcttttggacactgccttagttcagctcaagtgcatttgtgatttcacatgtaaaaaaaattacaaatgagcatcatattattcttgcttagtgttcacaatgctttggcgtccaggctatgttccccttcctttgcattaaaaaatgtgtaattttcatatgttagagctagaagggcaccaaagaagccatgaagatgagctttctgttaatctgttggtggcttgcatcatcattggatgatgcctactgaagcaaacgcaaaattctattataaagctaattcttaaacaatgtgcattacattcagctgctgtggccaccttagctgaggaagacatttctaagggatgtatggtccctgagggctctgtttaggcatcatatcatcaggaagtttatccttattcattcctactccttcctctctcccctcaactctgggatctatgttgttcaatgttgtactatcaaagaccgtattttattggcatttttttttccttttctttctctcctgctgtgagctccttgagggaaatttatgtttcccaggtctttgcatttctaaggctacaatcagaaagtgacacaaagtctacattaaaaaactttaatgaattataattatgaattataaccaaattaacaacactgaacctattattaatgatttaagatatgtagaatgttattgatatctttattcattgtgttccttttattgttgttttagggaatataaatatgtaagcgcttacttgtggtgttttatgactttgagcccccaaattttatattcattatcagatcctgaatgttcaactgccacaacttccatcacaggccaactcaggctgtcctagcaggctgctggatgccagtcacattaggctcaattcaggatgcagtatgtgctggagctggcacacacctgctcaaaggagctgatccttaaattttcaggaattatgtgagaagctgttaaacaatggatagcttgaaattggcaatggcaggagtatctataccaaagcaactggcaaatactacaaatcatatcactgcttctaatgagttacaaaggtgtgtgcttacatgctacccaaaaggaacttgaaggccttcatgtgaaaagatcatatgaataaacacaaagaaattagggaataatggccgggcaccgtggctcacgcctgtaatcccagcactttggaaggctgaggcgggcagatcacctgaggtcgggagttcaaggttagcctggccaacatggtgaaaccccatctctacaaaaaatacaaaaattagccgggtgtggtggcaggtgcctgtaatcccagcctacttgggaggctgagacaggagaatcacttgaacccgggaggtggaggttgcggtaagttgagatcatgccactgcactccagcctgggtaacagagcaagactccatctcaaaaacaaaaaaaaaaaaaaaaagaggaaattagggaataacaaactaaaccataatcaagccctaaatttaatataatcaagaaccaaaagttataacacaggtaagtgatacaggtatcagaaatgggagatgtcacagtcaaccaaaattgtggggggatcttcagtgaggagttggaaaggatgcaggaaagagaggagaggaatatcttcaggatcaggaaccagctgaacacagctgaacacatggagccaagcacctcacatgtgtataggggagagtaaagagggcaacacgaatgccacacagcatgcagccctcagggggagtccactgcacacacgcctggcttctgtggaacttggttactggaagtaccacatctgttgtcttggtccagctgtagcagagccatggatacttaagagtttgagaattaaggtgattgcgtagccggtgcctcctctatttcacctgtcttgcttattgtctatatcctctgtttaatcctcatctcgaccctttccatttatgattagaagttctcttcaaaaatatttctttaaaagctttgagggctatttccattttttgctatcttcatttttgttaacagctttccatggttttcctcataatatatgctttttttaaaaaatataacaaatccccataatccagattaaagctaaacaaacgcaccaggcattaagcaaatcacaaactccaggcttttttctgtaatacatgatacaaaacaatcagtaacactcaattccaggaccaacgagaagggagacattataaaaaatttaaaatgtctcaaaattctgtcactacagattggccttttctgaacatttcatataaatggaaccacacaatatgtgtctggtttcttttacttggcagattttttttttaggttcatctatgttgtagcatgcgtcagtagattgttcccttcctcattcacacccatcttcctcccttccttcctctctccctcccttcttctctctttccttcctttcttcctcccttccttcctctctccctcccttctctttccttcttttcttcctcccactctcctttcctccccatctttccttccttctttccttccttccttccttccttctattcttcctctatttctttcccagatagcattccattgtactaatgtactacattttgtttatccatttaccagttgtgacacaagttagggttgtttccactttagaaataactgtgaatcatgcttcagccaacattaatgtgctattctttggatagaaatatgtttttatttcctttgggtaaatagtggatatttgaaagtggaatcattggatcaaatggtcaacttaggttgacatttttaagaaactgccaaaccattctccaaaatggctgcaccaccttatattcccatcagcaagtgtgagggggtcttattcacatcctggccaacattccttgttgtctgtcttttttattataaccattgttctgagtgtttagtggtatctcactgttttgatttgcatttccctaacaacgactgatgttcatcgtcttttcatgcatttatgccatgctttctaataaagcattcatttcaaaatacattcatttgactattcgcaactgatcttttcttgtcactataaatccccaacttagaaaaaaactcttctgatcttaagagtattgtcttggtgtttataaccatcacctaggtgtcagcctgcatggattcttttagagaatggcacccaataattgtcctgtttctgtgtgctacccctttatgtgaacagccctgcagaggaagagcctgctggatgttcctgatggccctccagacctgctcttctctcttgtctcccctcatctgtgctctggaggctgactttgtaccaggatcccttgtgtctggcttcggatggagacacaggcaggtagagagcaacattgaagagcatttttcctctgctccctcactgtgggctgcagtttggaagtagccactgcctttccctgcctagtttttaattctggccaagcagaccctttccaggggctgaatacacttgaaagctcctaccaggagctccctcctctcataccttcagggttagagatggtaagggctgttttgggtgactggtcccttattcttctccacccactgatgggtcccttaaccttgtcaacccttctggagagagcttctttttaactatttatttatttaaatagaatagagatagcatctcactttgttgcccaggctgatctcgaactcctggactcaagtgatgcttccgccttggcctgctgagtagctaggactacgggcaagtgccaccatgcttggctaatttttaaattttttgtggagacagggtcttcctacttcctatgtgacctaggctggtcttgaactcttgggctcaagcaatcctcctgccttggcctctcaaaatgctgagaatacaggtatgagccactatgcccaatctggacagagcatctttaactctcatttttcaagtgtgtcttctcctttttgctgggactctgatacaggagataagcaaaactcctttgtgaaacctaagaccagcacttttatgcataaaacaaatggttagtgctaatgattaacttaaagtagtttcttcagacatatttgacacaacattacccactagtgcctgttcacctctgatcttgtagcactttgggcttttcacaaggacttgtcaccctctaccttgctttgtactcacttgcagtaggagacaattcccaccaccttcaccccaaacagcataaaaatgtaaaagttttttccagtttccctaaagtcatctgagcagctctccctaacccagaggagtgcaattactctaagaacctgtccatacaggcgttttttagtagatgttctttactcagattggagttatgaattgctaaccgtctaaattctctactgattgggagaatgagatgaggagtgaggggaagaaaggaataaagactcatctgaagcttcctaagagggccagcccaggagaaaacagccatgaggcagttcaaatctgcctagccaagccagggacaaggagctgggaatccccacgtgctgtaactgtcacaaatgccacactcaaatgcagatccctgggccactacagattcactgtattaatccattctcacactgctatgaagaaaccctgagactgggtaacttataaaggaaagaggtttaattgattcatggttctgcattgcttgggaggcctcaggaaacttacagtcatggtggaagacaaaggagaagaaggcatcttcctcatagggtggcaggacggagtgagtgtcaagcaaaggcggaaaagtcccttacagaccatcaaatctcttgagaactcagtatcacaagaacagcatgggggtaaccacccctatgattcaattacctcccatagggtccctcacaccacgtgggaattatgggaactacaattcaagatgagatttgggtggggatacagacaaaccatatcattatgcccctggcccctggaaaatctcatgtacccacatttcaaaaccaatcatgccttcagcattaactcagaagtccacagtccaaagtctcatctgagataaggcaggtctcttccacctatgagcctgtaaaatcaaaagcaggttagttacttcctagacaccgtgatggtacacgcattgagtaaagacagctgttccaagtgggagaaattggccaaaacaaaggggctgcaggccccatgctagtccaaaatccagcagggcagtcaaatcttaaagctccaaaatgatctcctttgactccatgtctcacatctaggtcatgctgatgcaagacgtgggtccccatggtcttgggcagctccacccctgtggctctgcagggtacaacctccctcctggctgctttcgtgggctggcactgagtgcctacaggttttccaggtgcacagtgcaagctgtcagtggatctaccattctgaggtctgaaggatggtggccttctcaaagctccactaggcaaggccccagtagggactctgtgtgggggctctgaacctacgtttcccttttgcgctaccctagcagggcttctccatgaaagccctgcccctgtagcagacttctgcctggacatccaggcatttccatacatcttctgaaatccacgcagagtttcccaaacctcaattcttgacttctgtgcactctcaggctgaacaccatgtggaagctgccaaaggttgaggctttaaccctgtaaagcaatggactgagctctacgttgacccctttcagccatggctggagtggctgggatgaaggacaagtccctaggctgcagacagcatgggaatcctgggcctggccaatgaaaccacttttcctcctaggcctccaggcctgtgatgggaagggctgccgtgaagacctcagacatgccctggaggcattttacccattgtcttggtaattaacattcagctcctccttacatatgcaaatttatgcagccagcttgattttctcctcagaaaacgggattttcttttctatcatgttgtcaagctgcgaattttccaaacttttatgctctacttccatcataaaacccaatgcttttaacagcacctgagtcatctcttgaatggtttgctacttagaaatttcttccgccagataccctaaatcatctctctcaagttcaaagttccacaaatatctcaggcaggagcaaaatgctgccagtctctttgctaaaacataacaagggtcatctttgctccagttcccaacaagttcctcatctccatctgagaccacctcagcctggatcttattgttcctatcactatcagcgtttttgtcagagccattcaacaagtctctagggagttccaaattttctcacattttactgtcttcttctgagccctccaaactattccaacctctgcctgttacccagttccaaagtcatttccacatgtttgggtatcttttcagcaataccccactctactggtcaatttactgtattagtccattttcatgctgccgataatgacatacctgagacttgccaatttacaaaagaaagaggtttaattggacttgcagttccatgtggctagggaagcctcacaatcatggcagaaggcaaggaggagcaagtcatgtcttacatggatggtggcaggcaaaaagagagcttgtggaggggaactcctctttttaaaaccatcagatctcatgagactcatccactatcacaagaacagcatgggaaagacctgcccccatgattcaatcacttcccaccaggtccctctcacaacatgtgggaattcaagatgagatctgggtgaagacacagccaaaccatatctgcaagcaaggagggatgtacctttagtagaattaaaccacttatttatgtgaaatactaccactgctatggtctgaatgtttgtgtcccccctagaaattcatatgttgaaatgaaatcaccactgtatttagaggtgggggcttcaagagttgattagatcatgagggcaaagcctcatgaatgagattagtgcccttataaaggaggcctgagggagattgcttgtcctttctgccatgtgaaaatacagcgagaaggaaccatctgtgaaccagagaatgaaacctcactggtgactaaatctgccagtgccttgatcttagtacttgccagcctccagaactctgagaaatacatttctattgtgtataagccactcagcccatgatattttcttatagccgcctgagtggactaaggcagtaatgtaaagattttactagcttttatagtaaaaatctagcttttctagtttgttcttcatatatatatatatatgagcattttcaaacagagtacttctggaagctgaacaacagtgtctcctgttaaaaaattcaaatcctcatccaaattgacatacatgtgctggcgcatatgttgtttatttctctgctgtttataccaaacttttcctgcaaacgcatccatcacacacacatgtggatacgcacaggcacacacatccaaatacactgcaggtaagacccactactactagtctcacagtttcacagtgatgttgggccaaaaacctgatccattattacttactgcggttcacggaagcagctttgtaaacctacataaagattcccccttccttgggaagccataaatgcaacgtttcactgagcagcatggaggcagggtgttaacctgctgtgtgactgctttcaaagagccagcactcctcagcagaagcctaatcatctctgtggatgtgctgtcctgggcctgcttcgataagtgctgtttatgtggctgtattttcaagatagcatggagggatgctaaacttggtatttgaaatctgtttttcctcacggcagcaacaagcctgcagcacagcgctaccagccagctagccaaccccacagccgcctgttgggcaaaggaaccctggaactcgttgaggttgcaggaacatacagaagatcatttctcctctttcattttcttgctgccttttctttcttaaaatcttaacgtcccaaaggaacaactgatgtgagtcagtatgtgttggcagggcaggatggtgtgtgtgtgtgtgtgtgtgtgtgtgtgtgtgtgtgttcgtgttcattcttcctgttcctgttttcccacctcagccttgggtgtcgatgaaactttttttttttttgagatggagtctcgcactgtcgcccaggctggaatgcagtggcacgatctcggctcacttccacttccgcctcctcagttcaagcgattctcctgcctcagcctcccgagtggctgggattacaggtgcctgccaccatgcccagctaattttttgtatttttagtagagacggggtttcaccatgttggccaggctggtctcgacctcctgcccctgtgattctcccgcttcagccacccaaagtgctgagattacagaaatgttttatatacctatttgctccaggcagagtttgaaggcagagacttatatcaattagagatccataaaagccagtgaggtgacatgaacaaaagcattcccaccaacactggaagtattcaagccagattttaaacatgagatttccactttaggataaaggttggatccgataactttgaagatcctctgccatttaaaaattctatgggccagacgtgatggttcacgtctgtaatcccagcactttgggagacagaggcaggaagatcacctgaggtcaggatttcaaagccagtttggccaaggttgtggcacatgcctgcaatcccagctactttgaggctgaggcacaagaatcacttgaacctgggaggtggaggttgcagtgagccgagatcatgctcctgcattctagcctgggcgacagagtgagactctgtccaaaataaacaaacaaataaataaattaaataataaatacaaaaataaatattctgtgatgccatgatcttactcccagtttaatgaacagttctgatggtgatgtttagagtgaaactcatagtttccttgaatattttcctactttgcatatttcccaagatgctttttccattttgaggaagatacaagataagatacttctcactgaaagttctcctttaaggggagaagcaatggcatctgaatctcaaagtttggaaaaaataaaccgttttttatctcttggctgaaggcaaagtgaagaagtaaccacagctcagctctgtggagagtgggggtggcagatgggaaggtgaaggaaggaaaagcaaacacagtcagccctccctccacactggcatccatgcatccacggattcaactaaccaaggaccaaaatatcccaaaaataagaagaaaaattaaaatgacagtacaatgaaaaaaaaatacaatctaataagacaatagagcacaacaactatttcaataacatttacattgtatgaggtattataagtaatctagagatgatttaaagtatatgggagtatgtgcccatatacacaatggcaaatcctatgccgttttatataagagacttgagcatctccagattttggtatctgaggggaatcctggaaccaattccctgcagatactgagaaacaacgctatgctctgggcagaagtacttccagaagagccacacgattgttcccctatccttgctcaacaaaatgccagcatcagaagaaacaatggaaaaacctgattctttcacaagagctgacctctgactataaaggatttagggacaagattcccaacctactctatatggcaaaggaagaaaataaaatgttatcttctttctccccagaggtcactcattgcttttcctctccaaaatatgcttgtcttagttcattcagcggctataacaaaataccatagactgagtgtcttatacacaacaggaatgtattgctcacagttctggaggctgggaagtccaagatcaaggtgacagtggatttagtgtctgctgaggacccactttctgattcatagatgatgctttcttgctgtgtgggcactaatctcattcataaaggctctaccttcagggcctaatcacctccccaagccccagcctcctaataccatcgtattgggggtgaggatttcaacatgtgaattttggggacgtagaaacactcggcttatagcagtgctctttttattttgccttactgatagctaaggtcactctgtgtgcacatttatttcacacttgaagcatccctggtgtttttaataatcacctccagcctgtcacgtgaaattaataacacacacacacgactccatttttcatcaaggccaccttccagaaagaaattactctttgactactcagagaaaggtgcagagattattataaaaatcaggagaggcaatgaataatatgaagaaattcagtgtcccaagttcttttcctcccacacttatttgtagccagtgtgatcattccttatgcacctaaactgcataatctaaattaattccaatgtgttgtagagtttcaccaccattacagtttgctgtgattagcaaaccttaacctagtgccttcatgtagaagtatgactattttcacagttttgtatgaatgtacttgctatatgaccttgggtaactcactttaccttctttgtcttggtcttttaccatctgtaaaatatagtatagtttttccttctccatattttatgattaagaaaaaatagaagatggttagaaaataataggaacacatgattcatgcaatcatgccaaaagtaccaggaaatcacatttcaacatataatttctatgcaggttatcagtaaagcacatctttaaatcactttcaatcaattcacaaggtaacagaattttgatttttttcccctttttaggtgcggattaaatatcccatctagattaagttttatatatatatatatatatatatatatatatatatatatgtaagaatcaatgcaatatcatataggtctcaaaatacgttattttcttactccttctttacattcttctcattaagtcatttttttcacttaacaaatattaattgagtggctactatattccaagaagtatgttaggcatcacaggctctcattttatctatatgcctggtgacaggatagctttgccttgactatatggtgttttcaaattttctttcttttctttttcttttttttttttttttttgagacggagtctcaccctgttgcccaggctggagtatagtgtgctatcttggctcattgcagtatctgcctcccggatacaagtcattctcctgcctcagcctcccaagtagctgagattacaggtgtgtgctacaatgcccagctaatttttataattttagaaaagacaaaattttgtcatgttggccaggccagtcttgaactactgacctcaagtgatccacccacctcggccttccaaagtgctgggattacaggcatgagccaccatgactggcctcagattttctattgacttcatttctatatagccagacagtaatgaattggttctgctgaaaactgtggtcaggataagttagaaacccttttgtttccttatgtatgtctttctaaatttctgctgagctacatcttaataccttattcccagacctcagctcagtgccccagtgcctgacacaaaataggctcaaataataattagttgaaatataaataatgatcataatgctaaatgacaaacagcccttctactactgggtgacctcgggcaagtcactgcatctgatgctctcttcattcataaaataatagacaaggctggtggttgctaaccagctgggtcaagactggtgttattgtaaagatgtgaaaatgcatatacattctataataagtcctacataaaaacagaatatactatttgtcatatatatatgtatgtgcgtatgcacaccacacataaaacaaataacagttttacatgcatgtagattactgtgtctaagaaaaccagtatcatttaaaagcactgtagagtttataacatcttttggctactatgtatttcgttaatgagcacatacaaaaatgtaaaattacaaccattttgacattctaaaacaccttcacactccaacagggcatcactggattaaatgatcttcaatgtcctatctagcacaaatatctgtggttccaattcaacagaaagcagaaaatatttctcaagtgttagctatatacacagcaaacaaccaagtggaaagcagaaaatacagccaatgaactctacaagtagaaaatgtgagcattttctctttttttttgagatgaagtcttgctcttgttgcccaggctggagtgcagtggcgcaatctcggctcactgcaacctccacctctcaggttcaggtgattctcctgccccagtatcccgaatagttgagattacaggcatgtgccaccacgcccagataatgtttttgcatttttgtattttttgtagagacgggctggtctcaaactcctgagctcaggtgatctacccaccttgacctcccaaagtgctgggattacaggcatgagccactgcacccagcctcattttcttttttactaaagctgctgccatgactggctttatcatgccactccccctcccctgtccccaaggtacactggcatggtcctgctctccagagtaagttctacacataaatgacccttttccctttgtccagtaaatggctgggccatgtcctttaaaccagcagtagctgttaactcttggttaaccacaccccatacccacaatgtcaagcaataaatgtttttgggagataactaaagaggctgctggaaacatttgctgcatgttcaatagtgactgacagtggagaggagggagtggtgggcatttcttttatttttatattttgagatggaatcttgctctgtcgcccaggctggagtgtagtggtgggatctcagctcactgcaacctccacctccagggttcacatgattctcctgcctcagcctcccgagtagctgggattacgggtgtgtgccaccatgcccggctaattttttgtattagtagagacagggtttcaccatgttggctaggctggtcttgaactcctgacctcaagtgaactgcctgcctcggcttcccaagataggcatttcataagaatcatacaacctgtcctccctgtacctggggcatacacagaccaagggtacaatgcgtatgagctaaagagatcctggctgcaacgtatttgagcaaaaaaataataatcatttgtattatacaatgaagagagatgatgaaatggttgtgacttatttgagaatataaactatagtgatcaataaaatcacatttggtgcggtatttaacccatttatagagatgtatattttcactctatgttaatttgcagggacatttgagaggaaatgtctgtataataaaaacattaaaatagaaatatttcaatctcagttttgcctaaggccccaagtccttgtttatcaggatttgaaaacaagataaccagaaaaaaaaactttatgactctgagtccctcagtcatcttgaggatataaatctgatatgtatattaagggttcaaaatggtaggattagaaattaaaataaggcttatttggataaattgttctataaaccccctcccatagggagtgtgggggagtttgcctctcacctcaatccaagagaaaggttttagacatcttgatatgtagcccctggggtttggaaactgtattagtcagtgttctccaaagagactgaatcaatagaatacagatatagatgtagatacagatagatgtgagggaatttattaggggaatggagtcacacaattatggaggctgagacatcccacataggccttctgcaaactggagaaccagagaagccaggagagtggctcagtccaagtccgaaggcctgagaatcaaggaagttaatggtgtagctctgtctgaggccaaaggcacaagaacccagagggccactgttgcaagccctggagtccaaaggcgggaaaacctggaatccggatgtccaaggccaggagaagaagggcatcccagctccaaaagagaaggtgagcaagagtctgccccctccttccaccattctttttctatctgggcccctagctgtttgcacggtgtctgtcaacatcagggtggatcttccccactcagtccactggcgcacatgctagtctcctgcatacacaccctaacagtcgtgcccagaaacaatgtttcaccagccatctaggcatccctcaatctagtcaagttgacacctaaaattagctatcacgcagactgatgtctgatttgtgctataacatctatggaaagagagacggtagcggatacgcagttctgattgtggcctgaagagagggcaacaacctgtccccacagagagtcagagcaaagaaagcccaagttccttagactctgctcaggaagcctgtccagccatgcaagaagactccagcagaaggaaaatgaaggggtgccacctgcatgcagcgggtgaagggctgaagaagggatcctaaacaaccaggagaggagaaacactcaactctgtcaaagacactgcagataggagatgtcaagtgaactgacaggatggattaggaactcttttttttttttttttttttttactttaagttctgggttacatgtgcagaacgtgcagttttgttacataggtatacacatgccatgggtttgctgcacccatcaacccatcacctgcaacaccaggctgccacaacacttgggttacacctaatgaggtgactccatttccattgtattgctattctggttagtgagaagacacactataggataaagtttgcattagaagagccaggaaaatatgaagtagaattcctctttaattaatgttaaagaacttaatcacagagggagaaataaatgttcacattggcacccatcgatatcatgaatggaatacaagctccatggtaccatgtgcttcctctcttgtaggatatggactgagccaccttggcaaactatgcccatggtatattcacttcatcaacaaagctagtccagaacattctatgcatttgcttcttataacctgattcttggccacttaagcagcattctcaatgcttccaatgagtgaaaatgaaaaaaagaggacaaaataagccaataattccagctcattagcagccaaaaaaaaaaaaaaagatctttgggcaagccaaagttctaaggggaaagggggaataacgacctaaagaccagtgccacgtatgtttgatactcttaactgtaactctggaacaacaacaacaaaaaccccatccaggtttaaaaatatgtgtaaaacaccatattataatataatctcatgtttattattttaaagtaggaaaatgcagatagtgtgtcttttgcatcactgttgaaaatacgatcattcattgaagacagagcagtggtatcctagttaaaactctttcaagttattcaacaataattgggagcttcatcaatagcaattgctattttccatcactgaatgcaactcattcctgaagcccattgaacactccagaatattgtgcaggcgtaggtcttgctgactcagttgtagccagcaatatttagtcatgctcctcgtcaggtacttctggctctctatgatgtggagaaatggtaggaggatgtcatttggacccctgtgttcaatggagcaatgtggttggttctggccaatgagctgtgagtggaagagacctgccgcttctgccgagcatttcgtatatgtgtgggtgtgagtatactctccttctcctcccatggtggccagcaacgttccaggggctgagccccctgagaagcaatgcccccatttgccagagtcagccatgtagtatgagtgaggaagaaaactttgtcttaagcccatgagattcaggggttatttgttactacctgttaacctcccctgactgatacaaaggtcttattgtctacctccttactgatattgactgatcaggtcacttactgaatatgcctggactgcaactcagtgcccatttttattttaaagatcgatgagttgttttatgattggaacttggggtaatacaaataatacatttcccatacgagcatcactaagagtaaacattgactgacaatgaatagtcattgttgatttgcacataaacccacaggtagattttgttcattttgtaagatagaaattagatgcatttgtcaggctgatgactgagggtgggagcatcatggagagtcacattagaagtggtgacacctgccatgagggcacagcatttgtgcaggtactgtgagaccaaatgcactgccttcaagctggatgcaatgtaatcaatccactttaacatgagtaatcattgctgagcatttaacatgagaatcatattataacacatattatgaggcgctgaacaatttggtgaagaagagagttatacaagttatatcgatgagttcagatgatttgaaaaaaaaaaagtggttagatttacaaaaggcaaggaaggaaaatgtgtaaagggaaatactctgtgctgctcctccagaaagacattccccaacagaggggggcttgccccagtgcggtaccacctgtgttggggcaggtaagcccacctctttgggtgttcagcattggataacacatttacctgcagatctaaaccacatcccgcagtgtagactttttcagtaataatggtggaaacctgatctccttggccttactactttgttctatgtttcaatttgtccagaatagggacagagaagcaagtgctgttgattggtctcttcaaatacagcaagggaaagtcctaatggagaagccagtcttaggctgagatgggaaggaaggaagaaatggggtttgaacgtgaggaggatgggaagtattccaggatacagtactatggcacaaaatcaaggactaaatgcttatctgtctattttttgagttctgtaaagtgctttcacatacatgataaaaatgtgtaatggcactgatggtcagtgtaaatcctgtgctctcttctgtatccaaacactggcagccctggactcctagtgaaggagacagacatgtgtcctgtttttgtggcgagattctagtggtgaagttagacaggaagcaagtagtacgtatataaagtattttcagatactgattagtgccatgaatgaaaataagggagggtaaggagacaggatagtggaggctcgctcttctgggcagttggttaggtctggtctgtgaagatgggtctttgatcagagtcctaactgcaaggagacaaagagccccaaggagaaacaggaagggaagaatctcaggcagcaagaaaggcaatagtacagaccctgaggggaaacgtgtttggctgtggaggaggccagtgtggccctaggggatcaggaggggtgagtccaggggaagaaagccataacatgcaagtagcagctggaggaggaccccaatgtccaaggtcaggggccctgaaatgaaagaaaaggccagtgaaagccaggactgtgcccagagaaggcgaagtgattagaacactcttgaaaatgaatctgctactgggttagggtgtctccccgaatgtcgggaaaactggccagaggtcattaaaatattgcaggtgcgagataattagaacctagccttgggcagttattacaggtgctaaaatctgaaaactcaaactgaggaaaattggcagagctgggagacttattggatgacaagggcaaagaggagagagaaatggcagacaattcagggtcactggctgactttcactgtcagtgatggcagacgtgggaggggaggccatctaacaaatgctcacgtctagggcttatgtagtcaacggtgagagcaacctgcaaaaaaataaaaaataaaaatactgttccaagagccattttttaaaaaaagaatgtcacgcagactgaaaaagaaaatcaaaataaaatcaagaaaagggattgtattacaaactcactattctcaagataaactgaaaaaggcaaatttcatacttagtaatgagaacaaaataaacactttcaattgattaatattgcaatacaatcattttgattatgtgtctttattttatttgttattttttcagtcagggtctcactgtcttgcctatgctggagtgcagtggcaacctctgcctcccagtccaagcaattctcccacctcagcttcccaagtagctgggattacaggtgcataccccgaggcccagctaatttttgtattttttggtagatatgggtttcaccatgttggccaggctggtgaactcctgacctcaagtgatctcccctcctctgcctcccaaagtgttgggattacaggcgtgagccacctcacctggccagattatgtgtctttaaaaaataaaaatgaagacatgcataaattagtatagtagaaggaaaaaagagatacgacaccttttatcttttttagggatcaatgaaaggccaagagatttgagaactgtaagaaagccctgagaagcacattgttcaaaatttatgctcacttgaaaaaaagaaaaaaaaaaaaaaaaaggaaatgacctaggctgttacaaaagttaaacccaaattgagcaccttttaaataaggttgtcaaaggttaagtatgtttgaggtaaaattatttccccagtctcaaaatgaaatttccagtagactttagaaaaaaaaaatatggaaaacaaacatacatggagaaactgcattttacaactgaacactgggtttcaagtagagtgatttttaaaaatctcatatttagatactgtctggttttaaaaataggccaaatggatcataggctgagaatcagaaatccttcttttgggttgtctcttctccgtaagcctcaagtacttcttagtcctttcttcatgactagataaaattatagtaactaccacagggattatgattcctagtcaaacatcaatcatagtcctacacacaaatgatgtcaagtgctaggcactgtctaggttctataatattagagttcctaaatttacacacgcacgcacacacacacacacacacacacctgagatagaggatagaaagataaatgatgatagatagatagatagatagatagatagatagatagatacatatacatagacagacagacagaaagatagatgctaggctgggagtggtggctcacacttgtaatttcagtcctttaggagcctgaagctggaggattgcttgagcccaggagttcaggagttcaagaccacctgggcaacaaagcaaggctctgtctctatgaaacacaaacaaacaaaaaattagctggacatggtaacgcacacttgtgctcccagatactaggaaggctgaggcaagaggatcacaggagcccaggaggtcaaggctgcagtgagccatgattgtgccactgcactccagcctgggcaacagagagagactctgtctcaaaaaaaagaaaaaaaagaaagatagatgctagatagatgatagatggaaaggggaaggaaagggaaaggggagaggaggggaggggagacgaggggaggggaggggaggggaaatcccttcaccgaagacttgtaggtcaggtctcaaagagcagccagcagacagccttcagctgtcaactacatcagggattgacccagctgcagagaactgcctcacacaaggtcacaccccttcctgggtgactcacaatcaactgacacaatcaataaaacctgtctgtcttgagccaagttggcacaactctgaagatccattctgattgtggagttccctgtgaggtctgtgtggctgggcctgcattgtagctcaatttctccccctcctcactactgtctcctctcttcccttccagatgtcattaccaaggatcctttttaattagcatcctatattccaaactctaaccacagtctgcttcctgtacttgcatatattcattacatacatatgtgtgagtgtacatatatgttttaaaaatccctagcaagagtaagtacgttatttggtcagtcagctgttaaaacttccactttctccagttgtctggtggaattaaaaaaaaaaaaagactttcacttttattagtgcaattcatatcagtgtgccactggtagctcttggaagagaaggaagagagagctaatatggaacctggagacaagttccactctgctcctgctgaatgcccttctcctttgcttctacctacctccagaagtgctggccattgtcagctcctgaaaaggctgatgctctgacctgtttcagtgaacggggagaggacttgaggctgggaaacctttggaataggcaaggggtccccctacataggcttccctccatgactcatagtgtgttccttggttcgctccctgtggtcaaccacctgctgcaaaaagtcgttcactgctggtgtgagaatcattgtcacctacactcaagtaaaaatgtgtatcaaaggaacagatgcttctcttccatgcaacctgaatatagatctatcaggcaaattcagacagctgttctagatgcagagaccatcatatctgctaggggtcagcaaacactgaccatggctcaaatctggcctgccatcagattttgttgggcccgggagtgaagaatgttttcaggcttttcagtggttgaaaaaaataaaataaaaagcataatatttcataatatgtgaaaattatataaaatctaatttgtagtgtccataaataaacttttttcttttcttttcttttctttttttttttttttgatactgagtctcgctctgttgcccaggctggagtgcagtggtgcgatctgggctcactgcaagctccacctcccggtcacgccattctcctgcctcagcctcccgagtaggtgtgactacaggcgcccgccaccacgcctggctaatttttttttttaatttttagtagagacagggtttcaccgtgttagccaggatggtctcatctcctgaccttatgatccgcccgcctcagtctcccaaagtgctggaattacaggtgtgagccaccacgcctgtccccataaataaacttttattaggacacagccatgctaattcatttacatattgtctatagctgcttttgatccacaatagcatagttgggaagttgtgacagatacctgaaagccaaatatgtttactatctggccctttgcagaaaaactttgccaaccacagagctatgcgatttaggattatacaacacaatatcacacatttgcttattggtgaacatccaatgggtggatattcacacagatatagacttgttacctgtacatgtctgtaagtatctggcctctcataaaacactaaacaccttccacagaagtgcacaatgatgtagagaccccacgttatgctcaaacccaagcgctatctttcttcacatctttttagttcaaaatatctgccttaaaacagaactggaaaaacaacatttgtcaagtaagtgcagccgtgttaatgttaaatagatgaatgcatggatggatcttttaacatacaagcaatggagaagatatgccagcaatgataatacttgtgttagtgtgaagggtattttagatctgccccaaactcaggtagaaaaagtttccctgaccttttccctaccagtttagaattttaattcatcccagagagtcagtggctttgacacaatagcacttactcttcagatgcctaaaattttatggtcaaaaatatcaaaagattagaaatgtgattttcaatcccaaaagccacattgaagttcaattaaacaaaaatgcctggggttttcatatgcactgaaaatcataaaaatcaattttattacaaatctacccatgaaaccgtctatctgtctctccatccatcaatttatttctgcaatatgtctcaaaatagcacccaagagtttgtgccaattcttatttttcaagatatatgagctttttcaagttcacaagctccataaacttcacaaactccatatggtgttcacaaaggaataataaatgttttttatcttttacattgtttatgaacacataattcatttttactatatcaattgcttgcctaagaagttacaatgcttccttttctgcttattctggcttacaagcctttcagaattgaatcttacctgatctgttcaatattacattctacattacacacccaatttcactgtatctcacccacctgtcttcctacacactaaagcccttactcctcctaatcgccatgttttcattatctccatgtcccttttatgtgttgttctttctacaaagaaaccccttttctcctctttttgaaaaacacctacttatccttctagaacaacctaaatgtaggaactttccaaattctccagggaaatatagcccttccttccttccatccatccatccacccacccactcacctactcactaatttatcccttactgaacaaacatactgagcatctattagatgctcaaaaatgtataacaaataagctatttctgcttggtttataaggacactgagatatcagcaaagtgttatgggaccgaagaagaagaaaatagaagaaagacatcaaagtcaaactggaagtaggacagtttggaaagcatttcccagaagaggtgatactgagttaagtatacacaggacaagaattatgcagccaggtggatgagggatgggaagaggagaaagggagagggtgttctaagccaaaaacacagcaggtaagaaactgagtcaccactaggaaagttaaatcaatatggcagaaagaaaacctgctccttgggtcatttcatcatgcgtttggtagagcacttacaactttatattaagtaatatgggcttgaggttctgctttagataatatggacttgaggttcttctaccttttattacctgtcagaaatagggttttaatccctgggaggtgaagcttgcagtgagccaagatagcaccacggcactatagcctgggtgacagagcgagactccatctcaaaaaaaaaaaaaaaaaaaagaaaaagaaaaagaaaaagaaatagggttttcatctggaaatatttggggctaagtgttgtcctgaaaggaactttggaaaagaaatattccattacacttgctttgtcatcttgtgatacagactcagcccatggatcaacaaaatgccttcattctcaacagtccaaagagctctgggtaggatctcaccttccttacaaaattcatgtcagatgttgaataatagacattattctgttcctcttccaagtgagagacaatgagtggctcatcccctgaacggtgtgtggaataaggtgaaacatgtagcaatcaagaaactggactcatcccctgaacggtgtgtggaataaggtgaaacacgtagcaatcaagaactggactcatcccctgaacggtgtgtggaataaggtgaaacacgtagcagtctagaactggctgcagaatatatgtttggattttgtaactttcatgctcccaaaactcagagtcatttttctacattggctctttccctgtattatcaattgtacccttcacataacaactgtttcctaatggcaaccaatcaattcagaattcaaatggcgattcgccagtttgatatctacgttgccctggggttatggaagaagctgcaaattttggggtactgttccagcttattaaatctttttattgaaatttgattcatcttttcctgaccttatcaaaccatcccggccttgtcatctacagcaggactttgcaaagtggactcctgtcgcttgctgcattttactggtgtgaaatcagaaggagtatggtggataatgcattttgaatccggttagacattaattattaggttggggcaaaagtgatagttttttttgccattaaaaaaccatgatcacttttgccccaacctaataacacccaaaccacctgtagaaatgatttaagaaatcttcaactcaaatgccttctttcaggaggagttttaaaatagaaattacatcattccaaggttgtgtctgcatatgcagttgtatcaaaaaacttaaatgtaatttttgagggaactaagccaggagaaagggccatagtgatgaatgtatccaaaagtagccatcagagaatccgtgagttcttacactgacacaggaagaccactgtgtttgacagatgcaaaatttccattcagatctggtcagcactcttcacctaactggtgtttttaagagataattaaaactgtttgcacaatggcacagtccatgacacattaataataataactaataacacattaataataataactaataataactaatggcacagtccatgacacattaataataactaatatataataattatattattataactaataactaataataactaatataacgaattatattaatgatagtaactaataatgtgaccatgacacattaataataactaatattaataataataactaatattcaatttaattctcatttctataagtgccaggaaatttgctaacattgtatgtatacatgtaatacatgtacattacatctcatgtaatcataactgttttattgcttttttttttttttttgagacagagtctcactctgttgctcaggctggagtgcaatggcaccacctcggctcactgcaacctccacctcccaggttcaagcgattctcctgcctcagccacccgagtagctgggattacaggcgcctgctaccacgcctggctaatttttgtatttttagtagagatgagtttcatcaccttggtcaggctggtctcgaactcctgacctcaggtgatccacctgcctcggcctcccaaagtgctgggattacaggcttgagccaccgtgcccggccaactgttctattgttaaagcaggtagctaggcagacgtgagcaggtcaggagaggacccccaacccctccccaggaatgtcagctgaccactaggtaatggtcaggaggttgttaaactatttctctaaaataataattgattgcagctggtaccaaagaaagaccgtctcccaatagatataaaacacctgaaactggtgatcagcttccaaataagatctcagaagttgggcgagcacgctaagcatgtgcactaagaggcaaaatggcggcgtttaactggtatatgagcttcctccaggaacgctctgctggtaagggaaaaacgcctcaagtgagcatgcacacaacttcagtaaacacactgcgcacgcagccccttccaagtgctgacaggccactgtacatgcggacagcccgctccgaaggaagaatcaggggagaagaaatgcaagcccaaaaaccctgccaaggtataaaaccccagtcaaggaccggatggggcactggatctctcaagtcacccacttggtcctctggcaagtgtattttgcttccttttgttcctgccctaaagctttttaaacaactctgactcctgctctaaaacttgcctgtatctctcccgctgccttaaacccacttctaccccttggccaaattctttcctttgaagaggcaaggatcgagtttctgcagacccatacaggttctccactggtcacaccatcaagtaagcattatcattattattcccattttacagaagggaaaactgagtcttaaagttataagctttcttccccgagttcacacagctaataaatacaagaggagaatttgaagtaaggcagtctgactctggttctaaaccaagtttatagtctattgatagctgttgccattgttaaagcccatgtcatatttagaatatagttccagagttggcacattggaaatgacaatattactttaaaaaatgtgttgaagatgggagttaaattgttttggaatttgccactacataaactatataataggggcagatatgagcagtgtcagattaagcagagacaggctccgtggccaggaaggcataaccatttgcggcttaacacagccaaaaggtcagaaagggggttcattcgagggagccaggaaacggggcctgaagcaagacttggcagtgacctcctaactttatcagtgaaaagaaggtgatttcactcagcctgctcagtcctagggctcagtagctttttgtggagatgactgcatagcacccctcttttcaaatacagggtggaggaaatcaaaatatctcaaaacatccttctcggacatattttgagatggatgttcagagggccagcagatagaagtagccatgcaaagctgtcttttgtcggggagatacacatctgcagagaaaatctgcattgatgtagccaggctttctccaagggcctcccctgtcctcttccagatctaggaaagattaaccgactgtcgacacctttgaaggtctgaaagaaacatttaccatctattctctctgagggcggctacctgtgagatttcatctacataacaagtgatctttgctagccagggctcctcttctctccctcccataatcacaacctgttttgccacaatccaagcccccattctttctgcaacctcaagatggtacataagcttctgaaccccactggggagttgggataatcactctgcagttttcccccatgcacatgttatctatgaacagaaggacaagttagttaccctctcctcacaacccacacctcaccaacaagcaagccatcaattttgcagcagactgaagctggaagtcctctaattcagttccactctgacactctcttcctggagatagcgtcagatcccacaggttgagggctcagtccccaagaatgccccttgcttctgacgcgaattacaagtcccagtttatttcacctgtgcttctgacagaccagctggaaattagagatcccatgatcccctgcttgagttcaattaatttgctagagtggctttctgaacctagggaacacttatgcttactggtttattataaaggatattacaaaggatacaggtgaagagatgcatagggtgaggtatggaggaagggttgtggagcttccatgaccttcctgaatggctccaccctccaggaactgccacatgttcagctatccagaagctctcagaaccctatcctcttttttttttttttaagcttcattatgtaagcatgattgactaaacctttggccattggtggtcaacttaaccttcagcccctttcccctccttggaagttgaggggtagggctgaaagtcccagccctccaatcatgcattggtcttttcagcgtccggtccccatcctgaagccacctagggactgccagccatcagccaactcattagcatacaaaaagacatcacttcggagattctaaggattttaggagttgtatgttaggaaatgggatcaaagaccaaatatatattctacaatatcacaggagtccttgaccaaactagataggccaggtctggcagactgttgctagctttacctcatctttcaatttttctagagaagtcagatatctgaacattaatgtgaaattttccatgtttaaaaaatactgcgcaggccaacaaaacacatcccctactcagattctgcgcatgggccaccgatttgcaagtggcatgtgctcatatgtacttcagatcaatacattctaataccgaggcaacttttttctcagtaatctaaatttagggaactattctcagaattgcccataggtcttatataatctgaacatcacaagagaactcaaatgactataaccataatcgtagaactgaactgtgtcattcacatgctgtcatatccatcacatttccaactcattccaagcaaatcctcagctgatcctgtgtaagggctcactccttccctatgtgcgttctcatcatttgatgaacttaactttggcaaggagctagaagacttagctcttgacaccacagcatgagatgggaactaaattggtatatgacttgattcttgggcacagcagtttatgtttttaaccaacactcattccagaagtagactacataagataagtagcatacacacatatgcatttcttaaactaccgatttaataattcattccccaaatacttaatgattgcataccatgttacagaatctatgctaggggtcgagcacacaatatttagacacatgcacacgtatgtttattgcagcactattcacaatagcaaagacttggaaccaacccaaatgtccaacaatgatagactggattaagaaaatgtggcacatatacacatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggcgattgttgtggggtagggggaggggggagggatagcattgggagatatacctaatgctagatgacgagttagtgggtgcagcacatcagcatggcacatgtatacatatgtaactaacctgaacattgtgcacatgtaccctaaaacttaaagtataataataataaaaaaaaaaaaaaaccagccctgaaaaaaaaaaagaaagaaaaagacaacctggtaccaaacctcaaatgcttttacccaacagcagtagttctcaaaatttggcccccagatcagaagcatctgcatcggccactgagaaattgttagcaacacaaattcgtaggccccgcctcagaacctcagatctactgaatctgagagtctgggaaccaggctcagcaatctgcgttgtaataagccctccaggtgattccgatgcaagctcatgtctgagaagctcatgtctggagaacatctgggggtggggaacaggggtagaattcaaataaaaaacacaggagactgatttacacatagtggccagaaaagcatctcttaatagatgacagttgaacctgaaaaatgaaatggagtcagtccttgaaggataggaagaagaaaacaggatgagtggggaaaacattttagggagaagcggcacacagcagtgaccttgtgcagacaaagaagtcagcgtatgcaaagaactgatcaaaagaccctctggctggagcccagcaaatgagaagagaatgtaataagataagattgaatcaatgactccggagtagatctgaggtgcagagatggcaggaagcgaaaggatgaccctgacggacaagagctggggctgagaatggggaaaagtttatgatttcagaagggagggagtcactctgtagctgaccaaggctgagataggcagggccagagattttgggtgtaaaaacttcctagaaagtgcctttagcgataattatttgcagacagaattatcgtgaataagtaatcagaagacttctgagtttttgaaagactgtactatccaataaaccacatttccaagcttcaagcccctgccagtcttcagattgcaagagaaccctgggccccaaagcttatgctgactatgcagtgccaaaagcagcatattctgcaatgtccttttttgggtaaggtcatgaataatgtgctaagaacaatctcttgaagggatgagacagagggcacaaagagagtgaacaatggaattccttccagaaggcagaatcaggccccatggagtaaaccccatattctctactgccagcgatgggaatctgttattcttgaccagtaaaatgtgttaattgctatgaaatactttctggcctgtgtttcccatcctcttcctctccaaatgagagtttttattacagtttcctgtgccactgctccattgaatatggggtaatacagggcatggataacctgtcttttagtttgtcagtcaccaaaataagaaaagcaatacacagacccgggggagaggacgtgaatgacacaggcattctggacttcagttcagatgcagtaactggttagatcttcgggcttgcctccttttgggagcaggtgagtgtgttatgtgtggggtgaagaatacatacaaatacgtgtttggccgggggcagactgaagcagattgttggatttcctccagtattcgttcttctcatctttcaatgtaaataaagtcaccaacttctgactgagcatacgccacctgggataaatgccaaatttcccagcctgccttgagatccggtggggtcatgtgactaagatctggccaatgtggtaaaaacgaatgtgtcatgtggcatcaaccaggagatttccacagggacagctgtactctttggtcctcctctttttttttttttcttgagacgagtctcgccctgtcacccaggctggagggcaatggcgcaatctcggctcactgcaacctccacctccttggttcaagcgattctcatgcctcagcctcatgagtagctgggattacaggtgcacaccaccacgcccggctaattttttgcatttttagtagagacggggtttcatcatgttggccaggcttgtctcaatctcctgacctcatgatcctcccgcctcagcctcccaaagtactgggattacagggatgaaccaccacgcccggcctgatccttcttttatatttccccttcctctttcctgctgtcagttacccaaatattacctcggacaaagagccaggtctgtactcctggggtggtgtggtcatggaagctggaaggggcaactgaaaacatcttggagcaaagccttcagactgcatgtcttcaagactcttgtgaaaaaaatgaaaactgtttatttggaatttctgttatttgcaaatgaacttatcttaaccaatatggactcttggccactaaaagtagcttaaattttactccaaatgcactagcaacccatgagagggtttcaagcattgagcacaataggctctgctgtgttacaatacttttaactctgcaaggaatgatgagaaagaggatgggggtataggccatgtggaaaatggcaccagcaaatatggtggattcaggagggataaaggggggacatttttgataggttttagaggtaacatagtattttttgataaatttgatgagattgaagagaaaaataaaatattatctatatctcatggataatacaagtgatacttatttttatcaagttagttgacaaatagaaatttctctgggaaattggaaatatatgcatggcagatactcactagggtggctcccatgattcccgccccagcatcagtatctttgtgcaatctcctcccctcgagtgtgtgctggacctgtggcctgctttcaacaagagaatatggcaaacttgatggggttatcactcccctgactacgttatgttatatcacaaaggttgggggattttgcagattttgttcgagcccctatagagttaataaaaaggaatatatatactgcatgggtctgacctaatcaggccctttaaaaagcatctttctctctctctctgtctctctctctctctccccccacctccccacctccccaacacacacacatagagagagcgagagagagagaactaggccaagagcccaatgagcagaggtagaagtcagagactgcaggcagcaattactctctctccattgctggtttggaggaagcaggccaccatgacttctacagctgcaaggagatgaactgtgcccataacctgaagaagctaggaagtggatcgttcctctcagagccttcacataagaatgccacctggttgacatcttcatttcagccttgtgagaccctaaacagaggacataaactgtccccagactcctgacctcctgactcacaaaaactgtgaagtaataaatgggtgtttttttaagtcactaaaaagtttgtagtaatttgttctgcagcaataggatactatacatacatacatttatacacacatgtaatatatatgttatatacattaacatgtcaatgtagaaaatgatatacatgtatctatatgtgtatgttccttaagtttatcctccttaagaaaatcaagtccttttttcatccacaaatgcctgtgaatgtgacaatgtatgtctatgtatgtgtgtttctttttttttttttttttttttttttgagacagagtctcactctgtctcccaggctggagtgcagtggcgcgatcttgggtcactgcaaccactccctcctgggtgcaagcaattctctgcctcagcctcccaagtagctgggattacaggcacccaccaccacacccggctaatttttttgtatttttagtagagacggggtttcaccatcttggccaggctggtcttgaactcctgaccttgtgatccacctgcctcggcctcccaaagtgctgggattacaggcgtgaaccacccgcacctggcctgtatatgtgtttctttaggctataattgaaaacagaatattgctactttgactttactgatggctagtataagatgaggtcatttcttagttataaaattaggaatttacctattaaacagaagaaattcaattgtgtttcatatatgtacttgtttctgtgtaagaaatcgattatgtttcttcctatgtatgttcgtatgcgtgtgtgagtgcatttataacaagcatcctcaatgcttaggagggttctcaaccagccaatttctcacattacctcaactgagaacagatagctgcagcaataaaagaatatactcagatctcggtgggtatcttagagacatccctgatgaaatctcacaatgactctgggatagctaccctgggctcccttttcagaagggccaccgtccatcagcatggtgggggatcactatggccattgactaacagagacagcagcaatctcatattctgcttttggaattctcttgacatgctaattccatattatcaaatatatcacgggtatcatttagacttttctgtacaatgtgttccagtcaccactccgacttttgctttcaattatttcccaaagatttgaaataacagataaacttaattttcatttatatgcctttctctactgcctacttccttttatttgtcaaatgtatgataactctttaaaattaaaaaaatacatattttacaagtaaaatctgcatgaatcaaccttgagttttataattaggtgcaatcatgatttaatgtgtttagattctagacaacttctcaatcatcctaaagagatacacattagccttatacggagacagaaacagagaaagaaggcctgcaaatctcttacgcatttatttttataaacatatattataaacttactatgtatctgaggcaccgtggtggggtgtatagtctatgacctcaaggctaccatgttgtcatggaagaggcagactggcagagcaatgatgcaattacaaataagagctgatgtgcaaaaggctgatggagatctggagggagcagtgcggaaagtgacttgctgggcagtaggaaagatttcactctatttttgtagcacaaacacaaaatcaccccaattcctggggtaaaaattatttatgttgcattttaggtaaaccaatagtattcttaacagtctttaatttctgttttcttctttaaactctactgcatccaagcctacagaggactcaatagtagaagcaataatatcatcattttaggatagtgagacgtgattggtgataggagtaatctaattagacaagcaaaacactctggagtcatttaatatttcagtgtaggagctatcagtcctataaactttaatcatcaggaaaaaaattattgctttgctgcacactttgtgataatagccatgagtcattaaagtaaggttcaattatgttcattatgttctatttaaaacggaaagaaacataccatatttagaaatctttctgtccaatgagttatctttaaatactacctaaataggtgaccgtttcaaaatttcattcatcaaatatgtcatttgttcataatgttggaaaaataaaatgccaacatactaaaaaaaaatcacattacatttaaatagttgatagtggtctctaaagttttttcctaatttctcagcataattccataaggcagacattgtttccattgtgccactgaagcaactgacacagtcacttaaccttagtcatgtaagtcacccagttcttttaactcctataaatgctctttcatttatccatctattaattcaatagactcatttattgagcattcatatgacccacgtttcataaaataaaatggcagacagtttaggtaatcctgtaaatctacaattataacatgattcaaaatttttctggaggtggattttctagtaacaagtgattcctagaggactttaactcactttacaatgaaatactacctgccatttaattacaccagggaatacttcgggtattttgagagatagatggattaagtcggtaccctatccgtgagtgacacaggtccacgaatgggaagaactccagctttctctgtatgttcctcacataaccagatactttaaatgactttgtaattttttgttcatctctcagttcagcaggtgaaaaaacaaaacaaaacaaaaaaatcaaatcagtcagagctaacgcatcctgtggagaaacaaaaggactgactctgtttctttcttcaatgggctgtttgatattgtgtagatttagtgtctgtgctcttcttaaaaaattccacttaacgacccaaaaagaagagcattactttcacaatttaataaatggaaaactgtggaatagaaaggttaagtgagctgattatgctcagacaagtccttagcaacatagcatttctctgccagagattacatgagaagctgcctttccatgattcccattgtttatgcagtcattctgtgttgtcaaggcactttttgatttttgtcttctgtttcctaattctgccaagttattctttttttaaaaaaggcacagcacacgtggcaatctaaaatccagagtttttcttggcatcactgattatgcttttggatgaatgaacacaccgacttggatgaggaaaatgcaaaagaaaaatagtaaaatagtaaaataagagaagtattatgttcaatatttgaaataattacagtcactcaggaaaaaaataagagcatcttaaaatccattagctaacaggactaggagggcaaagaacagcatgaaacagctattggaatttataccttttttttaaactcacagactaaaccaagataccattcatagtttaaggctagggggatagcaaattggcctcacattagaaagaattgtccaggctttgaattgatagcccaaagacaaaacaaatctggctgtgtgtctaaagtcagccttgattttgatgtcagttaatttgcttgtgactttgaaaactttaaattgttgccatctttaacccttgagaaatgagtcatctgtttctgtaaagtagaaaaggacaaaatcagcaagaaagaaaattttattttcaaagttcaaagagaatgcaataagtagtggagatgatttaccagtaactgtgctattgtttttctcaagagtttgaaatactctcttaaggaacacaaaaagcaaacaattttaagaataattgtagaagtcaggttttctttctctcaaatttttgcaacaagagaaagccgaggaatttgcttggcataactataaaggaaagcatagagcagctattgcaattttttttaaagacatgattagaccaccttggtatcttcaatacagtttccaaattattttccttgtaataaataattcatgatcagtattattatcctaatttttcaggtgcataaactgaggcccataggtttttatatcgctcaacaaagtgactggtttccaaggtgaaggtctaggatctgagccctactctgtgactctgtgaactccatcctctgacctctactctagctcacttcttccagtgaatcttcatactttgattgcctgcattgtactttcttttcctatacaaataaagatggcttgcctgtcttactcaggtcatggagttgttataaatatcaaatatcacaatgtatgtaaacatggtttaggaatttaatagtgaagagtttttattttaatgcatatagaaagcatgattgattagtctgaaactggttgtttggatttagagcagctattttagtggtaatctgaaaactacctgccaaacacggtggctcatacctgtaatcctacaattttgggagatcaaggcaggaggattacttgagcccaggagttcaagaccagcctgtgcaacacagtgagaccctggtctttacaaaaaacaattagctgggcatggtgctgtgtgtctgtagtcccagctactcaggaagctgaggcaagaggatcacttgagcctaggaatttgaggctgcaatcagccatgatagcaccattgtactctagcctgggcaaggagcaagaccttgtctctaaaataaaaaataaaaagaaaattactaacctttgcttcctgcccctaccaccacttactaccctcccatagtcaagctggagaattccagagatttatagtaaatcttccccatattcccattcttccaggacacactcagctaccacacctacccatactttacctggaagaaggatgagtgtgaaagcaccattcatgcttctgattgcattttaacctaacactcatgatatacagagtttgaccagtcaaagatgcaaatcattcccaaatgtgctgggttcctgtgtttaatgagaattataggacttgctatccaccttgaggtctgctggagataaaccaaagaaaaatatgagcaacagctctttttcatgaataggttgaaaacttgcccaataattcttagcagttctaggacaagacccaattttctacttgcagccttgtttgaggtcccaggttgaaaaaattaaaagtcagatactgaagcaccccaccaccttgattcacaaatgcagtttctatgtgttacaaccagaatcaggatgcaagaaacttcaggacaagaaaacttgactttgtccaaagtgtgattttgtcagagattaatgcttctgttcccaataccaagtaagaaattgattggttcagatccacagaatgagaatgaggaggcactgatgctgctgagaactcagtgcattgcatgtcacacctaaagcacacatttatttttaaagatctcaactcaatcattctgtttgccaggcactgggctgtgagctttctatgaagtattttaattaatccttaacaaacactttttatgtgggggctatcattttacacatgaggaaacagctagtggatccaaagctagaacacaccccaacactgggctatttgcaaaaagttagcaaaaagtacgtatctggggacaactgcttccttctcccctatgcctttgtgatcagaaggagtatttctatgagaggtggtcctgtgagtgtatgatgaacacttaaaaacaaactataaagctccttttagtgtgttcagaagcgaaaatgttttctatgtgttactagactccaattcacagaattttgtttttttttttttttttttttttttgagacggagtcccgaactgtcacctgagctggagtgcagtggcgcaatctcggctcactacaacctccgcctcccaggttcaagtgattctcccgcctcagcctcctaagtagctgggattacaggcgcccactaccatgcttggctaattttttgtattttttgtatagacagggtttcactatgttggccaggctggtctcgaatgcctgacctcgtgatccactggccttggcctctcaaagtgctgggattacaggtatgagccactattcctggctcacagaaaatcttagaagggagatatatgagaaaagagaagggatcattgtctcctattacacattggaagctataacattctctagcatttttataacataactgaaagcaaagcttagaagtcagtggtgggagatgagttcgctgctacagtgtaggtacttcagccatcacagatttggatgggacttgtctggttctctgagtgccagcttccttggtcaaggctccatgaatggtctcccaggactccacacatacagaagaggtcaaccactgcagagggaagaccaggctttattccaaggtttatgagttgttgcaggcctcaagatgcttggagactaggaagggaagtggacatctgtgtcaatgccagaatgctagccagaccatgataaataccataagagggcactaggaaaatacaagcattcacagaaaggagtgtgcagagccatggtggagggaaatccaccacagagcagggagaggggcttcagctgtcactcagagttaaacctggaaaaatcagatgtctacgaagactgaactttatttagcgatgggagcagcaatagttggagaggaggaaaaaccattgcaggaaaaaggaacagctacaatcaaacacatcaagacggaatgtatgggacaagtgcagaggcccatttagctaagaagaatagtgaacgaataagaacagctaaacatttaaagagcagtgattctttttgcaagtaatttacatgtagcatcttatttggtctgctataaagtaggtgctatcagtataaggcaagaactatcactatagccactttacaaataggacctcggacttaccacctttctatgagaggaggtcctgtgagtgtatgatgaacacttaagtcaactggctaatctgcctagacagtaacagagcagatgcagcctgctcccaggtcccctttgttattatgacttccttttaagtacaatatgggagataaggttgtgaaggggagttgtggccagaagtcaagagtcctggaacattatcctaagataggatcgagaagcatagaaagccttgaaaatgttcaacaggagttagatatgatcagagctgagctttggaaagaccgaagctatccaggacattattttaaaaactgagttactagtttgcttgcttgcttaagcccccacttcaaggatgaagggaaaagtgctgatagttatttctgggtcagtgtcttctgagccagaatcctcaagtgcatttccccactccctctacactcattttagttgcctagaagagtcttacaaagttttctaattggctgaggatcctaaacccggaaacaataaatgaaagtctgagatttgggctcaatcaatgtcacaggaaagaaggcactggggcttatatttttacataaagatgctgcatttggggtagtcaaagctcacacattctgcagtcacccccattacaggaaatggtgggccttggatatggctgactgtaatattaactttatgaggaaacagactctgctctgaagacttatgacctgagggaaagatggacaaacagaagaccaaggcctcatggtgggctcctctgatagcctcctgtgctgctttcctcctcagaaatactgaggttggacgtgaggcactcttcagcaaaaggacatttctgcctttccagcactaaaatggccatgagtaaaattgatatgtcaccgtctcaccaaagtgaaaaactgaagcggactcctaaggccacgcatggagcaaaactgtttatgcaagaagcatttactgagcacctgctgtgtgctctgcttgattgacttggatgagaaccatgaacaatatgaacaagtgccctgccctcaagagtcttacattctagggcaggaggaaagacacctgtaacaatcaagagataataaaatgtctgtgaaagtaaaatcagatcaggtcataaagtaacagagcagtaggctactccacagagcttgccaaggaaggcctccctgaagaggtgatgtgtgagcagacactggagtgacgagaagaagccagcgtgcaaagggccaggcaagcacatctgatggagagagttcagcaagtataaaagcctcaaggcagggaatgtgtttcccatgttcaaggaaaataaggaacaggagcctggagcgtagacagggatggcatgtacaacagaaaatggaagtaaagggggccccactggccagatcatctagggccgtatttataaatttgggttttattgtaaatataagaagccccttgagggttataaacagtgatgcgactagtgatattaatagtattaaaataggactgtgcatgttgagtgcagaatgaatagcacagaagcaaatgtggagacagagagaacactcaattgggtactgcagaagtttaggtgaaaaagcctggtggttttgactaaaggtggcaatggggaggtagaggaatgagcagattcaagatacatttttggagacaaagacaacaagacttcctagttgactgaaagggaggtgggaatggagaaagagagagtgattaaagataattactaggtcttagtcttaagcttaaacaactgattggaaagtgtcatttgctgagtcagggaaaagtggggaggaaaaggagggtcgagaagaatccagaggtccaactgagttgccttatgtttgagatgcttactggtaaaaagacagatatgtgaattaggtagttggatacataagtcaggagtctaggacaggaaaggcacagtggctcattcctgtaagcccagcactttggaaggccaaggcaggaggtttgctcgaggccaggagttcaagaaaagcctgggcaatatagtgagaccctgtctctacaaaaaagatagaaaaaaaattagttgggtgcagtgacaggcatctgtagtcccagctatttgagagactgaggtaggaggataacttgagcccaggcatttgagattgcaataagctaggatggtgccactgcactccagcctgggcaacaaagcaagaccctgtctctaaaaaaatgaaaaagtaaaaaagaaaaaagaaaaagaaaagattctaggagacagttgagatcgctgagggttagagacataaatttgggaatcgtaaaaatttggatgcatttgaagccatagaaccagctgtgatcactcagggagagattaaacatagagaaacaaccagggcccaagagtaaacccagggagttcattcagcacctgtaggttcgtagaaggtgaacagtcagcaaggaccaagaaagtagaaggaaaaccaaaagggtacaagaacacagaagccaagaaaagaaagtgttgtttcaggaaggaggacatggtcaacaggatagagagagtgattaaagccaattactaggtgacatgttgcctaagataaaggcagttttgagctccttcaaaggtatctgtttcctttgttttgatattgtttccaaaaactacatatcaggtttgatacgataccagaatgcagttaaaatgtaatcagtttatttactcaagatgtgtgggattatagaaacattttatcaattaccatttccatttataacttgtgcatcagttatagatcctattgtaagattgatatgcagccaaactgtgctatatactttcagtgttcactgtgtaagatactaaagggcttattacactgtagcccagcctaaagacacatgctaattatcttccatcatggtgcctgcactggctgtacttctactgaattgtaagctctatcatggtgggcacgtgcctgatatgttcaatcaaacaatagtttaatgtttagtatgtttgtttgtttgttttgagacagagtctcactctgtggcccagattggagtgcagtggcacaatatcgactacctacaacctccacctcccgggttcaagcaattctcctgcttcagccttccaagtaactgggattacaggcatgcaccaccatgcccagctaatttttttgtgcattttaaatagagacggggtttcaccatgttggccaggctggtctcgaactcctgacctcaagtgatccttccgcctcggcccccaaagtgctgggattccaggtgtgagccaccaggcagattttttaaactttggctgataaagtgatttaatcattaatcagtcagtgttaagagattagccctcccattggacatgctgaaaacaggcagctggcgactaagtgaagtctcacaggcagaacatctccactaaatcacagtctagctccaaggaccccttgttattcataatatttactgcatatttagtccccacaagctcatgattaattactgcacagattcggatggacaacatgtgacctacagtttccctctgcacagtaattgtagagggaaatgtaataatacccagtcagtctaaaaagcctattagtccaattctccacaaaattccatgaaaatataacatcacagcctgttgacttccaagaaatagtttaccaagagttgccataaacattagtacattttagttttagtgatagggtacttggcaaatatacataaaatcatacacacatgaggcactttgataggcactgaaaaataaaagacatacttcctgatcttaaagagtcctaaaatctagttgggtagatgcttttcataacatgaaaagctaactaatagttagacattgaaatgagaaaaacgaaatgttatgaggttctatagaattgacagctattgatgtgggccaggtatgagatggatatgaatcttcagtggaatctctgataaacacagaaagtgggccgggcgcggtggctcacacctgtcatcccagcactttgggaagccgaggcaggcggatcacgaggtcagatcgagaccatcatggttaacacagtgaaaccctgtctctctctactaaaaatacaaaaaattagccgggcctggtggcgggtgcctgtagtctcagctactcgggaggctgaggcaggagaatggcgtgaacccgggaggcggagattgcagtgagctgagatggcgccactgcactccagcctgggcaacagagcgagactccatctcaaaaaaaaccaaaaaaacaaaacaacaacaacaacaaaaaacacagaaagtgaaggataaacagagtaacataaagtatgtgtgtgttttgttcttcctcaaaataaaaaattatcagtcctagactattttatgtgagaaacccaccttgacacctgtttctcattgtatggcaactacaaagaagtataatgctgaacagtgcatctctagagaacagcttccatgtgggacagtgtttccaaacagagaatacattttctatccctgtaattactcttctattataataagatgtcctttgacacacagaatggcgttgtagaggagcactagatcaagagtcaaagggtttcagaactcctgactctgctgtgaatttgatgtgtgtccttgccatggataggacagcagcgcacgggagtcaagagctctccagacatacctgtcattcactatttgtgtgattgtaggcaaggcatttcagctttctcagactttatttcatcatctataaattgggaagaacagtgtctccggaaactccaatgcatgttagtaagtgaaggaagccaatccaaaaaggctacctactgtatgattccaactacataacattctggataaaggcaaaaatatggagacaataaaatgattagtggttgtcaggggttagaggagagggatggatgaatcggcagagcacagaggatttttaaggcaatgaaactacctcgtatgattctataacggtggacacacgtcagtgtaaatttgcccaaactatagaatgtacaacaccaagagggaaccctaatgtaaaccatggaccttgggtgataatgatgcctctatgtaggttcattaattgaaaaaagtgtacctctctggtggagtatgttgctaatgggggagattatgtacatatacggatacggggtataggagaagtctttatagcttctcctgaattttatcgtgatcttaaaattgctctaaaaaataaaatacatttaaaacaatcataaaagaacagtacttcggccatagagtagtaataattaaatgcgataaatatgtaaaggacagcacagagcttcctaaatagtcaatgttcaataaatgccagctattactctgatcctgtttcttagcatacagcagatcaaaagctgctgactggaattaaaggtcagagctgctagaagttatactgatggtggccagatgttacaggaggatacagaagaatgctaggaaggaagcatcagaactcaggaaacatttcttccaaggctatacagggagggagcaaataatggtctctttgttttttgttttagacactgggtctggctctgtcactggggctggagtgcagtggcatgattatgactcactgcaacctccacctcctgggctctaacaatcctcccacctcagcctcccaagtagctgggactacaggtgcaaaccactatgctgagctaatttttaaaatttttctgtagagacagggtcttgctttgttgcccaggctagtctcaaattcctggcatcaaacaatcctcctgccccccaaagtgctggaattacagatgtgagccattcctggcctgctctctatcttaacagatcaggaagcatcagtaccgtgcagagtcacaacctatagcattgtgatgtaagaaaagcaggaacatttgcctaagaagggctgggttggaattcttgctctctgttggtcccgtgctaattctgggtccttgactaagtccattcacgtccctgaactggatccctgccatcaccatgcgcaataggcacagctcagctactgtccgctctacctcagcagacaggactaggacctttctggcccagcccatcttgttgtaaataacaaagcatgccccataggactccaaagaataaaaaatcatactccatttgtcacagctgtgataatcactcacttttgctctaaaaatggagacagtatgcacctcaccaggcaactgagagaattgaatgaagtcatggcttacaaagcatttgggacacacaacccccagctccgtcaatgttagtgtggctatgaatgttttctaaatgataattcacacgctcaggtgccagcatagagctatacttgctactattctgacctgggtattgtgcctccgttttgaaaattgagtattcatcccgttcctgagccttagtttttccaggtcttatgaactggcttcttcctaacccggcatctcacgctttttttttttttttttttgagacagagtctcgctctgtcaccaggctggagtgcagtgatgtgatctcggctcagtgcaacctccgccttgcgggttccagtgattctcctgcctcagcctcccgagtagctgggattacaggcacatgctaccataccgggttaatttttcggtttttgtttgtttgtttgtttgtttgttttagtagagacagggtttcaccatgttggccaggctggtctcaaactcctgacctcaggtgatccacccgcctcagcctcccaaacgtttttctttttttttttttcttaaagaaagaatggaaaaatgcatacataccgtgctctggtccacatttatttgctttcattttggtaatcctctgggtcctgctgtgtgcttgctagtcccttatccagagcctgaagcccagactcagaacacagtctgctggctgggttcttctcctcattagagatcgcccaaataccactctcattgcttggacatacaagtagaccatgtcccacctctcaatccttgaacttcgttcatgtggtaagataccctattacactatttcttctgaaaatttccattactaattgtttccccgcataaatgattgcagtatgatttggttgcgtgcctatctatggcactcaattcccactatcagcacctgcaaaaggctcagctcagtcaccacgtgctccatctgaataggcaggactagaacctttctggcctggcccatactattgcaaataactaaacaggccctgtagatacccaaagtacaataaatcatgctctgtctcgcagctgacatttcccctggaattcaacagtctagatatatcaagtagatgggtgggtcaggtctacaagaagtctatctacatacacatggtattgaaaagtctcctgtgcggaaaagtcactctcagagaaaaaggagtcaaactgggtcaagtacaaaacttatactatagagaagagacatgcttctatgagttcaaatctgttttccagtctaggcctcccacatattcccacctgaattctagtaagagagtaagagaaagaggctctatgtagtaaaacagtggaatgcactgtagggccacatgggaaacatttggaaaagtaaacagtaaggagagaggggtattccctctacttctgtaccgccttggcacacgaaggacatcagagaacctggcatctcttaggcattcaaagcacattggtggcattatcgtcaggaaagagacagcagcagctaaaggaagtgacagcaacaccctgttgggcagatggacagaacaggagtcgatgggagtcagaactaccctctgagagtagctcacctgtggatcctggaagcaaaggcgaggcattttcatgcaactttgcacccatcaacaacagagaaaggaagcttataccaggaaaagtagagaaataatgaatgtcatttattcagtgactggattattattgcactcagtgataataaacatcctgcctaattgatcagcagaaaaaaaaatgtattgagtgaagtagtctagggatcatgactccacaattattcattgagctcaagagccaataaaaacatgattacctagccactctgttgacgacagcagaaaaattatattcatgtattcatctattcatcatttaaaaataacctgtaagtacctaaccacacatcaggttggtatgacaaacaatgtggaaacagatgattaagttattctccaaaggcatctcataggtaatgatatgcaggttgagcatccctaatttgaaattcccaaatcggaaatgctccaaaatccaaaactttttgagtgctgacatgaggacacaagtagaaggttccactttatttcctgtttcacacataagtacttaacacaaactttgtttcataaggatgtaacacaaacttcatttccatttatttaaaatattgtataaaattattttctggctatgtgggtaaggtgtatacaaaacatcaacaaattttgtgtttggatttaggccccatcccccaagaaatctcattatgaacgtgcaaacattccaaaatccaaaaaaaaaccccgaattcaaaacacttttggtctgaagcattttggataacagataggcaacctgtacaatagaatttcaggttccatgacagaaatatatttgaagagctataaaagcttgaattaatctactgaggaaaacagcagttcatagaagtttgactgaggaagtaacctttgaattggacattcttaagcagaatgaaggcaaaagaaaatattatggaagtggacttttgcaggaggtaatattctaaagtatgtccacaacagaaaaatcaggtaaagtttattcttgtacattccttaaatcatccatgaaatatacatgaatttgtgtgtataaccttatagcatttttaacattaaactttgagaaccactagtcaggtctaaggacatcacaagaaactgtccacatggtctacgtataaagatcattctgcttttaagataacttcttaacaagaaataaacagaaatttctattgtttctatttgtctgaagggtttactctattttattttaatatgaaatctctatgaccacctaacaacagaggttcaaaattcatgaagcaaaaactgatagaactgaaaagagaaatagaaaaatccaaagtgatgactggagatttcaatttcaaccacaatttctctgcagttaatagaacaaataaaaaataggtaaggatatagaagacatgaacaacagtaccaatcaagtggatctaatgtctatagaatattctactcaacaagaacagaatatacatttttttcaagtgcttttagaactttcaccaaattagaccgtattctgagctataaaacaaactttaacaaatcatgaaaactaaaaatcatactaattatgtttcctgcctgaaagatcaaaatagagctcaattacagaacaatagctggaaggtcctcaaatgttgtgaaatttaaaaacatgtttctaaataaccataagccaaagaagaagtaatgaaaaaattagaaaatattttgaattaaataaacacaaaaccacaacatattaagtattgtggtatgcattcaagacacagcttaaatgaaaattaataccaccaaatgcctaaatttttaaaagagcatctaagtttccatcttaataaactagagaaagaaaaacaaattaaacccaaaacaaacagaaggaaagaaataacgaagttaactgaagatatcagtaaaattgaaagcaagaaaacaaacaaaaccaacgggaaaatcaaaatctggttctgagaaacaaatgaataaaactgacaaatttctagccagattgaccaagataaacagagagaagttacaaattatcaatatcagggaaaaaatgggaaacatcacaaagacagcatcaatatttaaggaataataaaggaatgtcacaaactagatacttaaccacactctgactcactcaaaaacattttatgctcactcaaaaacctgcttatgaaagtttatagaggatttattcataatttcccaaatctgaaaacaatccaaatatccttcacctggcaaacagataaacaaatactggtacattcataaagtaacatagtttcacattttgattaagtccaatttatcaactgatgcaaaagaccacaagaaacaacatctaagattgttttttttctagcatttttacctgattgctatggctcttcttcaaacttcttttccctcaaattacatttcctaaccatatatatatatattttttttttttttttttgagacggagttttgctcttgttgccaggctggactgcaatggtgtgatctcggctcaccacaacctccgcctcccaggttcaaacaattctcctgcctcagcctcccaagtagctgggattacaggcatgcaccactacacccggctaattttttttttatttttagtagagacggggtttctccatgttggtcaggctggtctcgaactcccaaactcaggtgatccacctacctcggcctcccaaagtgctgagattacaggcgtgagccaccgcgcccggccatctaacataattcttatccagtactagcatatggctatgacaatggattcaatgttggataagacagaaatgtaagcagatgatgggtcttgaggtcttttgcgtcaactgttcatttgccaagtaacatgattcactcatattattctcatagaaacttaagctcccttaataacaaatcctacatacttctccagaatgccaaacgagaatagattttctagtttagaaatgagaaaattgtgacaatttttgaagtactgaaaaggttataatcagaggaaaggacccagtataaacctctgtgatttttttttaaagaaggcaaaaaaggaaaggcagatgttgtgaaggagtgaaaagagaaaaagggagagtgtagtgttacataaaatctcaatttaggctgaacatccaccaagattctactggaaatcaagcattttactctcatttcatttccctaggaatcctgtgaagtaggtaatagctctccatttatagatgaggaaaattcagtttagagtgataaatgacttattcaatgctacattgctagttaagtgaaggaggtaagatttacactaagaattagagattatacactttttttcaagtgccacttttgggagaaaaaatgattaaatatcagtataaaagtattattttgaggaaagaaggctccttaaaaaggtactccagttgtttggaataattgcagtctcgtttcagtctcagctctatatgcagtacagctcaataaagctctaatatgcagtacagctcaataaaggtggaatgccaaagttctcatcttttagcctcatggctgttgtcccacttaagggacacagaatggctttataaagaaattaacattaaccaagtatatactgccacttatctctcttgcctcatttctcaataaagaaacctgaaagttactttctatggctagcttcaccttgaagcatgtttgttttatctaataaaggaactgtttagcttaattccattactgattttggtgtcagatcacacgatataagctaacaaagatctacttcactgattgcattgcaacattatctgaaaataaaagtggggtaggaagggaaggagaagggagagatgaagagaggatggtaaatgggtacaaacataaaactaaatagaaggaataagttgtagtgtcagcagagtagggtaatgatagttaaaaataatttactgtatatttcaaaatatctagaagatatttaatgttcccaacacaaagaaatgataaatgttttgggagatggatatccaaattaccataacttgatcattacacattgtatgcatgccatcaaaataccacaggtaccccataaatatatacaattattatgtgtcaataatgaaaaaaagttagagttttatataacttctattatagtccttttcttttatcctcacacacacacacacacacacacacacaaaaagagacagaccttaaacaattatacagaaagttgtctacaaggatgttaagagtaataaccaatctactttttaaatagttgagtgggttttcagaaaaaaaagtattcaataaacaggaaatatgtgcaagaataaaaagagaaccttaattataattatgtatttcttttcagcagagtgttaaactctggtaatagaaaaaatatatttttttcttttaatccatggacattttatttacaaaatcttatgatcataggtttattaatgatcctcagacgttttactacaaaaaatgcttgagattataaaccacgacagaaacaaataaaaccacctcatgatagtcttggaacactaagaaaaagtcctaagactaatattaattgacttctatggtcaatggttctctgacattattgtgtgaccttaggtagtaaattagccactccacaaatttgtttacttatttaggaagagaagtagtaagaattcctttcctattaccacctcaaataattattgccaaattatatgaggaaatacacaccaaaatactttgaaggcttcgaaattcagcagaacttcaaactatcaaccaaacaatatacgagtgctccagttcctctacattctcaccaacatttggtgttgtcacttttgaatttttttttgagacagggtctcactctgttgctcaggctggtgttcagtggtgcagtcatagctcactgtggtctcaaattcctgggctcaagcgatcctcccacctcagcctcccaagtaactgggactccagacacatgccaccacacctagctaattttatttatttgtttatttttttgtacagacaagagtctcgctacattgcccaggctgaactatttttattttactgttctgataggtaggtatgtagtgatatatcattgtgattttaattgttatttccctaggtgttggacatctttttatgtgcttatttgctatctgtataactttggtaaaatgtttatttatatctttgcccttggtctaattgtttgcattcttactgttgtgttagaagttctatagtctatattctagatactagtcctttgttagatatggggtttaccattattttcttccggtctctagcttggcttttcatccttacttaacaaagtctttcacagggcaaaaggttttaattttgataaagtccaatttattcactttttcttttataaatcatgctttcggtatcaagtcttagagctatttgcctaggactagattctgaatattttttgctttttctttacactttttataaagttttacattttacatttaagtccatgctccattttgagttaatatatttaaagtttgtacaaggtgtgagacttgaggttcatttattttagtctatggacatttaatcgctctagtatcatttgttgaaaggtgatgtttccttcattgaattgcttttgaatctttgtccaaaaaatcaattggtcaggctgggcgcggtggctcacgtctgtaatcccagcactttgggaggccaaggcgggcggatcacaaggtcaggagatcgagcccacggtgaaaccccgtctctactaaaaatacaaaaatttagccgggcgcggtggtgggcacctgtagtcccagctactcgggaggctgaggcaggagaatggcgtgaacctgggaggcggagcttgcagtgagccgagatggcgccactgcactccagcctgggcgacagagcagactccgtctcaaaaaaaaaaatcaactggtcctatctgtatgggtatacttccacaccatctattgtgttccaaactatctattctgattgctagtggatttatgtgtctgttccactgataatcttgatactatagtgacatagtaagtcttgaaatgaggcagatttatttttatcacattatttttcttttcaaaattgttttagctattttagttcctttgaattttcatatgaattttaaaataatctcaatatttataaaaattttgctcatattttgataagaattatgttaaatctgtatgtcagtttgtgaagaactgagactttactatgtcgagttttccaatcagtaaaaattgcatttatgtccattaatttacattttgtgtgcttcctttgattagtactgtagttttcagcacacaagctctgtacattttgtaagatttacacctaaatatttactttaaaatgtttctgattattgtaaatggtgttataatttaaattttgattttcatgtgttcattgctatgataaatacaacagatttttgtatgtttatcttctatcttatgaatttgctgaacttatttatcagttctgtggatgtttttgtagatttttttcattttctatatagacaattattccatctgaaaatggtgactgttttttttccttcctggtttgtatgccttcccccagccccatcttattgcattagcaataccttccagcactatgttgaataaaagtggtggaacctgtttctaattgaagggaaaaagctttcaggttctagccattaagtgtaatgttagctgtagttttcttgcagaggggatagatgttctttatcacgttgtgaaaattctccgctattgccattttttttttttgcgacggagtcttgctctgtcgccaggctggagtgcagtggtgcgatcttggctcactgcaacctccgcctcctgggtttatgccattctcctgcctcagcctcccaagtagctgggactacaggtgcacgccaccacattcagctaatttttgtatttttggtagagatgggatttcaccatgttggccaggatggtctcgatctcttgaccttgtgatccaccctccttagcctcccaaagggagggattacaggagtgagccaccgtgcccggcctccactattgttatttttatgagaatttttttatcataaatgagtatttaatttttttaaatgctttttctgaattagttgatatgatcatgtgagcctttttttctttagcctgttaatacaattaaacacattgactgattttcaaacaatgaatcatccttgcatttctagaagaaatcccactttgattatgatgtataactctttatatgttgctgaattctatgtgctaatattttgttaaagacatttttatttatatttaggagatacatcgctctttagtttccttttttgaactgcctttggttttggttcaaggtaatactacttcataaaatgatttgagaggtatcttctactcttttgtctggaagagattgtgaattggtgttaatttttctttaagcttttggttgaattctctggtgaaatcatctggacctagatatttctttttggggagttttagattataaatttaagttccttaatagtcatagggccattcaaattctcgatttcatgttggtttacttgtaatttgtttggaattggcctgcttcatctaagttgtcaaattcatgtgtatagagttgttcatatgcgggcaggggtgcctcactaccatctaacagagatgtaaattcaggctccttcctgggctgcctctgttatcacccaggtgagggtgtttggtctcaacagagcctcacaaaggtcaaagtctacgttttctactcaggctttgctaacatgagcagaggcggggccaaacttctttctgtggtgtttggctggaatagaaaggttattatctaaaagctccatatcttgccagcctggccctttcctgatcatttggctagagaaaacaggtgtgtgtgtgtgtgtgtgtgtgtgtgtgtgtgtgtgtgtgtgtgtgttttgctttgattttgatttggcttggttttattttctgtctgcacgtgtgtgtgtgtgtgtgtgtgtgtgtgtgtgtgtttggtttgctttgattttgatttggcttggttttattttctgtctgcacctgtccgcatttccaggattctagttctttagcattaagaactcactgccatgtggtttttcaggtcccaaaggccccagctcaaatgtttcttttctccacttttcagagtcctttatgtatattttatgtataatgttcagaatttttacttagtgggatgaaaaggcaaagaatgcctacttcagcttctagaaacagaagtcatccaggatttagttttaaatgaattggtcaagatgaatttctggtacataaaataggcctagtcaaaacatgaataatttatccatgaaacaaattccttttcgtgacatttttccttggtgggccaatctgctattccccatcagaaaagagcccaggtgagagaagaagaaaatagaagaaaacagaaaatcaggaggactttctctttctcactcctcacttcattcctgcctcactcccaaggcaagttcagagccccacagtaccaagagttcaggaaaatccaagggctgaattcaacatccatctagccagtagagatattttaaaaatcacacatattatactgacttgaaaaaatattttcagcacctactttttaagtactcttatgctaaacacaatggagaaaattaaggtacaaaggcatagcctctttcagaaaatccataaaacctgtatccaaagaactataataatgggcaggttctgaagaatgacatagaatgggccacacatctctaggataggatttaaaatgtcatttaaatataacacaaatgtttgtattgggaactctaaattgtccttgtctacagccttcttccttccctttcttacaacctataagatcagacttaagtaaactcctaagctaattttgaatcatttgtcctccctaagcccataatcacatggctaagccaagaattattcaaacctaattctcccgcaagacctcatccattgctcactgctcctgaagatggtcttgagtatccccctggatctgggcctcagactgtctttgccactctcctgtgttaccacatggagttggtccccgccatgtttggtcaggtctcttagaatgataacttctaacatcatggatcctgaaaattagctaatgtgatttccaactactgtgtctcatctagctgatattatcaatcaattcatcctgcctgaatttataacaccacatttggatatagtgtttagttgcttaacatatgttcaataagcataaattaaatacatatagacaaatggtctagagcagtcttcatcatgcttctccggaaggatctagagtacttatacaatttgagaagattgagtttcataccaagtagggacagggtctggaaacaggcagtacacaaacacttgaatgtatgttaagactgagacttctgctacagaaagtcagaggaaagaatgtgactttcaggtgagatcagcaaagaaggattccctctgccacaaaataacaccttctttcccagaaactcagatttcctttgatataattcactattaattttcactctaggagatgaagcatctgaatgaatgttcctggaatatgcttggaacatgggaataaatcatgctagttgatatggaagacaaacacaacactccagcaatactctcttaggaattccctcatcaccatttaaattgttgattttctgctcttctgtagaaatctctagttctggatgaacataagcactgtctatattcgttagacagcacaatacatattagtctttaatttatttcacctacaccaaacctaaattttttcttcttctaactttatgtcctaattttctttacttaattttgtctacatttttgtcatcattttctcttagatttttgttcagctttccttgaaacccaataaaagcaaaaattatattgagaaaagacaaaatttcacatcccatattctacagcttgctacctctgggcaccaatggacattcaactgaaatataattttttaaagaattttatcagtataatagactcttggacttgaattatgaagcctaacaactggtgctaaatcagatgaaattgtgaagaaatgtctgcagtgtagctctaactaaaagctatattctaacaagtcggcgatggagcctccaactttctcatgcctctggatggaatttattccctaaactcagtaaagccactgactttcagaaaatgaataatctaaaaaaactgcaaaggcaaggcttttgttctttaaaaaaagaaatgaagctaacttctgcttatggcaatggagatcagtttattttgcaccaatttcctactgaaaataactataaaggctgaacaaaatgtccaaaacccatctgtttgaagtcatcagagagccatcaaggtaaagaggggcttcagggcaaataatctgacagaggcaagccaagagatgttcaccccccaaagcagttactaaaggcttggaggttgacaggagtatttaaaagtcgcactgagaaggacaacacaaatttgagtttagtgccttccaggaatgaaaaatccttggataaagacttaggatatcactctgcaatctacagggcttcaccctgcaagtgagtgtaaacagaaaatagaacaagccttataaaggtttaagaaaagttttaggtcagctcaagtcctaaaggattaaggtgattggcatctcacttagctgcctggtagaagcaagttgaagtcccacctggagaaaaacattcactgaagcctcaaaatgccttgcaagttttcatctaaaatgtatgacactcaatgaaaaattaatagcatattaaatagatttgaccagcggggcgtggtagctcacgcctgtaatgccagcactttggaaagctcaggtgggcggatcacctgaggtcaggagttcgagaccagcctggccaatgtggtgaaaccccgtctctactaaaaatacaaaaattagctgggcatggtggcgggcacctgtaatcccagctactcaggaagctgaggcagaagaatcactcgaacccgggaggcagagggtgcagtgagccgagatcgcgccattgcactccagcctgggtgaaaagagcaagactccatctaaaataaataaataaataaataaataaagatttgaccagctaacaagagggaaagaaaaccagacagtgcaaaattatccatgagaaatgcagttgttgtatttatctgataggacttaagataacagtgattaaaatgtttaaaagattaaataaggcaatacaattcagtgaagaacaaaaaattataaaaacaaagaaaatataaattctagaactgaaattaagaactttacagatagatgtaacaataagacatacaggactattgaaaaaatagtgaattggaagataggtcagaaataaatattgagaacaaaagagggagaaaaaattacagaaaataaagaaaagagcatgcaaaatttatgggacaggtacaatgaaaagatctaatacacatgtaactgaaatttcagtaagacaatgaaaagaaaaatggggcacaagcaatatttgaaaagatagttgctgaggatttttccaaactgatcaaatactttattcaagaaatgctatgagccttaagaagaaagaatacaaagaaaaccacatagctagatgcatcatagttaaatttctgaaaaccaaagtcaaagagaaatcttaaaaaaagaaagagatagagaaaaaagtgtattaacttcaaaggggggacaataagaatgacagctaatagctgacttcttaattgaaacaatggaagccagaagacagtagaaagatatctttagaaaggggtgggggcagaggtcaacctgtaattatgtatcagtattaagtgcaatacaaaaattcacaaaataaaagcattttcacacaaataagaactgaatgcaccagcagcagatgaacagagaaaatactaaaggatattcaagaagaagtaaatttgtactaaaaaatgtgtaaaaaaaaaccccatctgtttgaagtcatcagagagcatggagaaaaacattcatttaagcctcaaaatagcatattaaaaatatttgaccagctaacaagagggaaagaaaaaccagacagtgcacacaaatatccatgagaaatgcagttattgtatttatctgataggaactttaagataacagtgattaaaatatttaaaagattaaataaggtgatacaatttattgaagaacaaaaatttggcgatgcagaaaggaatgaagagtaactaaaaggagtaaatatgtggataaacacaagtgaatattgactataaaacaataatactaaagtcttatggattcttaagtatttagaaaattgtaacacatgagaacataaattagagtatgggtaaatgaggctaaagtgtattctaacttttgcattgagttggtgttggtaaaaatagtaatttatgttagacttgaatttcagggatgtattatatttcataagctagggtaagcactaatacaatggtaaaagaatgtgtatctgaccagctagtactggggagaaagggaaaaataaataatactgaatccatccaaaagaatgtaaaaaaaaaaaaaaaagaacaaataaggaatatgctgggttaattagaaaataaatgtaaagttctagattttaaacttaatatatcaataacattaaatgtaaatggactaaacactccaattaaataacaaacattttcaggctggatttaaaaaataattatatgacacaagagactcaccttaaatataagaatataaaaaagttgaaactaaaaatagaaaatatatataccataaaaatactaatcaaagtatctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaatcaaagtatcttaatctcaaagtagatggtatagcaagaagcaccactagagataaagatcactttccataatgatagaacagtcaatccatgaggaagacacattttaaaacttgtgcacagttaataaatagtgtcagaatatacaaaggtaaattattagaagtaaaaggagatatataaaaattcaaaattgtagtgagagatttccatacatatacttattaactgatggaccaggcagaaaaaaacaatcagtaaagagataaaagaccaaaaaaaaaaaaaaagattgcaaacttgatctagttgaaatattcaaaacattactactgtataataatattcttcccaaatgcataatttaccaaaattaaacattatctatctatctatctatctatctgtctacctacctacctacctacctagtttcaaaggtttggaaatgtgaagtatattttccaacctaaatggagttaacctagaaatgggtaagaaaaataagtagaaaatatcatggacttggaacatagactatttttcaataattcatgagcaagagaagaaattacaagagaaatttaaaaatagtttgaaataataatgataatgtaacatctcaatacttgtaaggttcaggtaaagtcatgcttagaaagaaatttatatttaatatatacatgagacaaaggctgaaaaatcaacgattaagcactaaactcaaaaaatcaacaaagagcaaattaaatgcaaataaagtgaaaactagaaaacaataaaaaataagagtggaaatcaatataactgaagcaaacacataatagaagaataactaagaaaaaaggtggttctttgaaaaggctaatatagttgatgataacttgtcaataccctgatcataaaaaaggcagaaaaaaatccataatgaacaatgagattattacagctcacataggcattaaaaaggtaatagaatattttgaatagctgtatgccaatgcatttgaaaattgacataaaatgaacaaatttctgaaaaaacacaagctaactaaactgacacaagaaaacgtatcatttctaaaaatatgaatatttctatatttgtgaaagaaaatacatttataattttaaaacttttcataggaaaatctataacctcagtgttgttactggtaaattttaccaaacacatttggaaaaacaaaataccaatcttacgttaagttctttcaggaaacagaaaaaacgtggaacattttccagctgtttttttgaggttaccataatcttcatatcaaacctgacaaggactttacaagaaaaatcaaacaccaatcattgtcataaacccgtatgcaaaaatattacaaatttgtgctaaccaaatccattaatatagaaaaaagataatatacaaccaaacagcctagttcggtttattccaagaatggaaaattggcataacatgtaaaatcagttaatgtaattcaccatatgaagagaataaaaggaaacaatcatctcaagaaatgtaaaaaaaagaagtcatctgattatttatctgatttatttataataaaagcccttagcaaacaaagaataaaaaaaaaagactttattggccggtctcacgcctgtaatcccagcacttcgggaggccgaggcgggcggatcatgaagtcaagagatcaagaccatcccagccaacatggtgaaacctcatctgtactaaaaaaaatacaaaaattagctgggtgtggtggcatgcctatagtctcagctgcttgggaggctgaggttgcactgagctgagattgcgccactgcactccagcctggtgacagagtgagactgtctcaaaaaaaaaaggactttatttatttagtaaacagtatctagaaataacttccagcaaacattatacagaatggtaaaatattaaaaatttttcctctaaaatcaagaacaaagtaaaaaatgccagtgttacttacatttgacatgtacaagaggtcctagtcaatgcaataaggcaagaaaaagccaaaacatgtgaggattttaatggaatgaatgacagaagtctagtcctcttccctttcaaaataagctgtggcttccagaaaaaaaaaaaaaagagaaaggatgatgggaatgaaaacaacagcagatatctactatgtttctctagatgaaaataaatatagttactctgtttttagctgacaactagtcagtgtcaggatattgatgaacctcagtccgtcaatcagaaaaactactgctatcatcacacagaaggggttagaattcaagctgtactgcctgctagctgtaggacctttgacaggtcatatagcatgtctagcatttagatccttcatctgcaaaatgtgggtggcagaagtacttgcttcctctgcctgtatgaagattaaataaaattatacaatgtaataaccctaacatataaatacaaaataaacgttagatgaattttactgaaattattagtaacaactccaaagccttggttccttcagttaaggcgaccactgaagttaatctcatgtgaaaataaattataccccaaatttaacacaaacaactataacaggtgatctggaactgaaaataataacaaaaaattaatgaagcttacattaatgagatatttaaatattaccttacttttttcaaaaagtgttccttttctctctctttcccatgatttttttaaaaaaagcttttaattgctgcaaaccggcagaaaaatacttatttatatcttaaaggtactgctcaatgaattttcacaaactaaacacgtccatgtaaccaacacccagatcaaattcttcccatgatttgatcattcagaaaatctttgacaaagaggttgacaaactcaagctggagtcagacaacccagatgctaattctggctctaatagggatgcactggttgacttaaattagctccttccctacatcctttgcatcctaatttttctcatgtggaaactaagagcaacacattcccctgcccctccaacctcttgtttcacagtggagttccaggaccataactgcaggcaaccaaaaccgtcttcctaaagctccctctcctttagcttccatgagtctagaccttcctgaatttcatccactgcccccggattattgcttagtttagtttctgttcatctttgaatgaagacatttcccaagattctgttctgcccccaactctcctcagtttctcattaaatttctcactgcactttctcattcaattcctggttagtttcatctgatcacctccatgtccagacttccaagtgcaaaatccaaccctaatttttctccccaactccagtccaagattttcaactacctgctgatatcttcaagtcctgttgatacatcagtcccaatctatcaaaagagaaatcatctttcctccccataccttctccctatgttatattctttactttgattaccacttctggtcacctctgtaagacacctgggaatcatcagctttctctggttcacttgccaaatcttgttaattctaccaccccaatatcctttgaaatgtccctttgtcactatgcctaccccacttctctaattcagttcatctgcctgagggatttcaagagtttcctgactgatctgctactcatggatctaatttctgcaatgcatctttcattctctaatggacttcttttcctaaaggtgtgtcagatcatgaaaatttcctgcctttagtcatcctacataaaagcagaataaagaacaaactccttggcctgtcaacctaaaaggacggttcctttccagaaccatccaccatgaaatagcatcatacaaattacactggagcctcaccagagtgtgcactgttcctgcatttccataaacccatgattttctaactttttgcctcttctgtactcaccaaagtgatatgtatccttaaatttcttccctggccttcacaatcagaataaattagcccttcatttcagaaccaacaccacttttttttaatacatatataagaacttaaaaataaaactacttttgtctactttgtgtcaagcatttgaataggtactttatatgctataattcatttaatcctcattagttgaatcttcacagcaactttacattttagagatgagaaacttggtctaattaaggctgaatggttcacccgaggtcttactaaagtgaagtaaacgtaggagccaggatcagaatccaagactttgggattccaaagtcaattttctttatacttcgcaaaataatttctacagctaattgtttatatgtgtctccctaaaagactgcaagctctcagctgagaatgtgaataatctatttcagcccactacctcaaccctgcaaacacacagacacacacagacacacacacacacacacacacacacacacacacacagagacaccctaattgggttacttccacaacagtttgactctgtaactgttgaggaggtgaatgaataaattatcaaggttcttacattaatacctactcagatcttatgatagatattaatgacaaaagaggtatttctgtacctgtctctgtggaacttgcaaacacagaaaagaacaataacaaaataacatcagttgtagcatttactagtccagaaatagctcacctatgaaacaaacacaattttaattcattttccccatcccctaataggaaaatagttctttctgtgggggccaagggaaaacttccctgtcacactctgaaggttcactgaaaatcactgacaaaaggcagattaacaagagaaaaggcatacaaattcatttggtcatagttttgcatgacacgggagccttcagaatgaagagccaaagagacaggagaaattgtccatttttatgcttagattcaacaaaggatgaacagctgtgttgaaacacgattgggcaaaaagggaatgatctaatggtaacagactgagtggggaagctcagcaacgcctgtctgtttagatttctgggcctctctgaagctttccttccttctgggtatgaggcaggcccctctctggaatgcaggtgttatgacctacagtcaaacaagtcagataagttctttacggctagtttttatacagaagtggggaggagtgtagggggcagttagagtagtatttttaggttttatggctggctttaggggaaaggggttctggcttctatgacccgccttcaggaaggggaattctagtttctatgcctaaccttgggggagagtaagaggccagagacaggagggaacgaggtcagagaaacatgcttctgagtccctcatattgggatatcattttctgagctttaacatttctgtaagaataatgacaactaatttgaggtgcagcactaaaaatagaaggaatctagcagctcttgaggggtccatcctgagttgctttgttctgatcacttagcatgtgatcttgctacctagaaaattattttacctgtggtttttctcattgaaacccaggccataaattccatcctgcactaccttccttccactcgatcacatttgcattttttggctgccacgagacttaccttgagttctgcttctttttttatttttatttttgagatggagtctcgctctgtcaccaggctggagtgcagcagcgtgatctcggctcactgcaacttccacctcccaggttcaagcgattctcctgtctcagcctcccaagtagctgggactacaggtgcccaccaccatgcctggctaatttttgtatttttagtagagacgggtttcactgtgttggtcaggatggtctcgatctcctgaccttgtgatctgcccacctcgggctcccaaagtgctgggattacaggtgtgagccaccgtgcccggcctgagttctgcttctttccaagatagatcctctggttttctgttgattctgtgagcaccaggtactccaaagaatatcatttcaacaaacagttttctgtttaaaccaatcaaagtaagatcctatggcttgaaattaagaatcttgcctgacataatccctgtctcttgataaacacaaacaggcaatcaccaaaccagtgccataactccacaactcaatttttaaaaattaaaatataataaatcccctctcttttcatttattcgttcgttcatggcaggtacatttctagataatgaagatacagttataaattttgatggattttacaattttcatatctttgttattggcaaccaaagggtataacatgcacagtccagacaaggaagttaatcagaaacagtaaaaacttatcttcccgaaatgataacctgaaggtcaaatacaacaggagctactcttgccctttcaaatggccaacaatctgaagatatcaactaaatgccaaatattaccaaaagtaaatactataggagttgcccagtttgttaggtgagagtttaaaggaaactttagaaagaatgagcctgaaatgatgggaggaacacaggtgtgtatagagaaggagggatggaaccatttatggtgaaattttctcagaaatggcacaaagaaaggagctcaagaatcacagtcaacacccaaggaggagggtaattcattggattgaaaggatcccagaggaataaaaagttgtagaagaaaagaccaaactattgcatttgctcaccaagttctagagaattattttatcctctaggtcacagagatgggctgcagggggtggatagataagatgtggtgtgcaagttcttaaaatatgtactgcatatcatacattttaggtgggtattggacaattttcttagtgaataaagaggaaattcatttagcaaaaatcaaaattaaggtaactctagcattctttttcctttctctctgaaaaggtaataattgtgatatctgccaatttataatagaaatgtttaaaaacaaaagaattaaacttagagagttctccttaaaagtcagacaaatttatcaacaaaagagaagaaaccattgtctcaagtgtctttttgttgtttctttattcttcttattttctgcaaaaaaaaaaaagaatgagcctatgaaaagcaatgttaatgatggcacactctggggttttcactaatgttttaaataggctttacatagagcagcaattatgtgagatgatatagttaaacagtatcgataataaaatattccatttgagcacctcaaaatactttggactaattcatattagaacatcttgctatcagaactgttgagtttaaaataatatacacatatgtatatgtatactcatatattatataaacacagttacacaaaagtaaatttatttattaatagattcatccctttttatctatggtcataaaattcaaggatcagtaatagaatccatagatcccctaaattcatttgtgatttttttttttttttttttgagatggagtctcactctgtcaacaggctagagtgcagtggcaccatcctggctcactgcaacctctgcctcctgggttcaagcgattctcctgcctcagcctccagagtagctggaattacaccactatgcacaccacgcccagctaattttttttttttttttcagtagagacggggtttcaccatgttggccaggatggtctcgatctcttgacctcatgatccacccgcctcggcctcccaaagtgctgggattacaggcatgagccactgtaaccgactgcatttgtcatcattttttaacatctttcttattcataaaccaattagctagtgggaaaaaattaattagcatttgtaggatatactttttttttttttgagacagagtcttgttctgttgtctaggctggagtgcactgacacgaccttggctcacttcagcctccaccccccaggttcaagtgattctcctacctcagcctcctgaactacaggcatgcaaccaccacacccagctaatttttgtatttttgtatttttagtagagacagagtttcaccatcttgcccagtccagtctcgaactctagacctcaggtgatccacccacctcagcctcccaaagtgttgggattacaggcgtgagccactgcacctggccaggatatactatcttgattttttcctaatcttaactttaaagatgctcctatgaataatactaataaggtcccaggtaatgagagagaacaaagggtaaagagtcttggtaattcccaggctagacaaatattaatagacctatggagaggtacaagacagctgacttgttagaactgtgcagtttgttactgaagccaaaaatttggcagtaatttctagacagtaatttcgtaagtgttttttttttttacatttatgcccccatgtttaacccactagcaaattcagttgactcagcccccaaaacacacctgagataatctatttctaggcatccccattataatcaccctggtcccatggaccattatttctggcctgaactaatgcaacagcttcttaattggttttgctgttgccattcttacccagttacgatccatttgccccatgacttaaagaatgaactttttttttttttttttgagacagagtttcgctctgtcaccaggctggggtgcagtggcgctcggctcactgcagcctccccttcctgggttcaagctattctcctccctccgtctcctgagtagctgggattacaggtgcccaccaccacacctggttaatttttgtatttttagtaaagatggggtttcaccatgttggccaggatggtatcaatctcttgacctcgtgatctgcccacctcagcctcccaaagaatgaacttttaaatacttaaccagatggcttcattcttcttttaaaagtttctcattgggttcacattgctatcagtaaattaggaacttcttactttggcatacaacgtgagaagatggaactgccatctatgtgcccaatcttattctttgtcacggtctttttcatgtaccatactcccagctgcccttcctcagttcctcaaacacaccaatcccatttcctccttacggcattgggactagctctcacatgatttgaaactctcttcctgctcacctctccatgttaaccctaacttaaatgtcacccccttaggccatgggaacacccaatttaacctaattcttcagccacattacatggctcacctttaattctctccatagcacttagtgctgtctcaatttaccttctttctttctccctccctccctctctctctccttttcttccttctttctctctctggttttttttttttttttttttttttttgagatggagtctcgctctgttgcccaggctggagtgcagtggtgcgatctgggctccctgcaagctccgcctcccgggttcacgccattctcctgcctcagcctcccgagtagctgggactacaggtgcccaccaccacgcccggctaatttttgtatttttagtagagacggggtttcaccgtgttagccaggttggtctcaatctcccgacctcgtgatctgcccgcctcggcctcccaaagtctctttgtttctttctttctctctctctctttctttcccctttcccttctaaagatcaagaattatgcatgctttgttcatcactgtgccaggtatggagtatgcactttaaaatgcatatatatatatgcgtaaatatacagctatgtacatatagtttacattttgatatcatgcagaccgatagctatgaaatctgattattcattcagtgaaggtttactaaacacctatatattccaggcactggaatatgagacagacaagactactgtcttcatgcagcccacatttagctcagggagacagagaactaacaaacaaatgaacaaacaaaagaaaatttcaggctgtaataactgctaggaataaaattaaaaaggtaatatcaaagaaagttataatggacttgttcaaaaagcttcattaaccaaacgcaccaaaagaatcaattgaaatgttcaagtagaagacattttgcaatttttaaatatcttattctccaaaatcttccacacgtttggaagcagttgtccataaactaccttcgaatgaaacatccactaaattactgccactagaaaaagaaaagactggctcaatgctcaagattaaaatgcaggctgacactttctgctttacttgttttggggttgtgtggagaaatgctgacatctttgccttttttctttgagatggaatctccctctgtcacccaggctggagtgcaatggtacgatctccgctcactgcaacctctgctgcccaggttcaagcgattctccttcctcagcctcctgaatagctgggaatacaggcgcccgccactgtgcctggctaatttttgtagttttagtagagatgggagtttcaccatcctggccaggtggtcttgaactcctgaccttgtgatccacctgcctcatcctcccaaagtgctgggattacaggcgtgagccaccgcgcctggaccatctttgccttttttgaaaatagaaagagtagtaattcttgcattgagaatatgacataatcccaaccccaaaccatgagtctcatggccatgtctaagccacgccctgacgatagggttgggatgactacgccaggcttagtaatgcacagggacaggaggcatttcggaaccacaccacgacactgctggcaagaaagatgggaaaacggcagcaattctgtctgctgtgctttgtgtgtgtgttctacctggctgattgaatttcctcccaacacctacctcagatgtgttgtctaggtgaaaataagcacttcaatgagctggtctaattttaatcctcagcccttcccagtcagccccgcccccatgtagttacctccgtcatgacaaagaggaacatcccaggtgcaaatctagcacagtttccctatttcacctgtgtccccctccccatcttcatgccagcatcagaaacaagagtccaaacatcctcggcaacactacagaagctgttcaaacaatccctgtgttctttccaatttgccgacgtggtctggcaaacaaagagatttctttgtttctctaagaaacaaaggtttcgtaagagaaaccttaagagatgataaatacaattaatagagagatagccaggcaaggtaagagaatgcttgactgttttaactgcttatcctgtgctgtaacagcttacctaagagatgtcagagggacggacagaaacctatcagcgctcaggcagaacaggtgctccagtggaggcaaggactgcgcctgcatctgtccatgcagaaactatgttctcatggatacaggctgatgatagtaaattctggtgggctatttactggtggagtgtctgttcccaaagaaaattaattattaaatcagtgtcaacttagagagatgtctctagtggtctgccgcagggcactgtctggggcactgtctgaggcactgtccactctgccacttttaacagtgctttgatggcctggggcacacagatgacacacttatctatgtgtgataacgctcagcctagaggaacacagaatgtattgaataaagggatctgattcagataagtgggcataatggaaatttagcaaggtgatatttaacaaaccgcgagcttaccttaaaaataaaaatgaaatccccatgagaatggatggggagaatgtaataaacattagtacaaataagacttaggagttttaatttaccattaataatagtaattgtaataatgataatagtaggtagcacttatcaagagtttatcatgtaccaagcactgttctaataatttaaaacttatcattagaggctgggcatggtggctcacatctgtaatcccagcactttgggaggctgaggcaggaggatcacttgaacccaggagtttgagaccagcctgggcaacatagcaaaaccatgtaagtatgaaaaattttaaaaattagctgggcagcctggcatgcacctgtagtcccagctactcaggaggctgaggtgggaggattgcttgagcctgggagactgaggctgcagtgagctgtgttcatgccactgcactgcagcgtgggtgtcagagccagaccctgtctccaaaatataaaataataaaataaagaaaattaaaataaaatatattattaactcatttaatcttgacagaatctttagagtaccttattggtatctccattctataggtgaagaacagatgtaaagtaacttaaaatgaatcaataatgtaatgtcattgtcaaaaagtattaatgtgatcttagagaatagggtccagaacatgagaattgataaagcttctctaactgcacttaaattattgtattctgttttgggcaaaatggagccttgaggaaaaaggttagcatgaccaggaatgcaaccatatatatatatattttttctttttgagatggagtctcgccctgttgcccaggctggagtgcagtggtgctatcttggttcactgcaacctctgcctgccaggttcaagtgattctcctgcctcagtctcctgactagctgggcttacaggcttataccactatgccccggtaatttttgtatttttagtagagatggggtttcaccaagttggccaggctggtctcaaactccggacctcgtgatccacccacctcggcctcccaaagtgctgggattacaggcgtgagccaccacgcccggctccaggaatgcaaccatttttaaagaggaacaatgaatagaaaagtctgatggatttatggctaaataacagaaagaagggtagaacatgagagtttgagtgaggacttcaaacccttcgtaaagttcagtttaaatagcatgaaacatatgccctgctgctttggagtgtggccatgaaaataatagcaaacacattccatggaatatttactatgactttcccagattacaaagtacaaggattagatgtggaaaagaataaatagaagctcaataaaaagcaaagctttctagtgggattgctttgtgagatgggaatcatgcctcactgaggatgtgcaggcagtggctgaaatcagatgacacagggcgaagggacctccccggatctctactctgtgagtctataaagaataaactgcagacactattttggtaatagatcaacataagaaaatttaaggctagaggtcaattgtggtaaccaaactaaatgtcctctgaaaaggcctccacctgtacttctaagtgtttccataaaatttagtaaatattggccaggtgtggggctcatgcctgtaatcccagcactttgggaggacgagaaggatggatcacctgaggtggggagttcaaaaccagcctggccaacatggtaaaaccccatctctactaaaaatacaaaaattagctgggtgtggtggcgcttgcctgtaatcccagctactcgggaggctgagtcaggagaatcacttgaacccgggagggggaggttgcagtgagctgagatggcgccattgcactccagaccctgtgtgtttattcactaggctatcccctgcccacccagactccatcatgaaatgaaaggcaggcatagcacaatattagtcagataagagtctcatattatgtgggaaccatgccattttatttctgaaacagcaacttcattgtgaggcttagaaatccctgagctttgtggcaactgaagacctgtcaccgtcaccgtagctggagtagtgagcaacacgaggtggtgggacaaaagccattcctttaagtgtcctctgtacctgacaaaagaggacatcaccaaagacctagcatacagttggtactcataaaggttggctgaattgaggctaattttctagctgcagcaccagtcctgtttataaaaaccggtcaaatcaatcttctacaaggaattgaacttcgagcactttgaagtttctaaatggaagtctgtatgtttcatcaagcttaaaaaacagtccaaggcattgatgtagcaaggcgttatggtgtcatagaaaggaaactggacaaagagttaaaacaaaaacggatttgaatcatggtctgtctcgatgcctcagtttcctaatgtggaaaacaattttatttttcacaagattctaaaaatccaatataattgcgttaggtgaaaagcattctgtgtacggtgacaagttatacaagtataaataatcaatatcattactaacaattacattattattaattgaatgagtgtattcacccattaatcattaccaatccattattacatgtgtattattaatgattattattcaattattatatgtattcatttattatacatgtaataattgagtaataaattattcaattataattaataaataatagttaattattacatgtgtaataattgaatacatgtactaattgagtaataataacaaatacacatgtaataactggatacactgaaggaagtgtattcacttatggtttataaacattccaacatcagatatgtaatatttgcctctttgtcatttagaataatctgtatcactagtcaagtgtttgtatccaaaacccaggaacagggtcgacttcgtgggtgtgtcacctgagaggtgacacacggttccaagcttaaagggccttgtgcttggtttaatgctctgctgtttccatcctgaaattcttattagcgtatgcatttttattttgtgctggacctcataaattatgtagccagtcctgtggtgtgaataaaagctgaatctgaagctgccagggtaggagagttggaggaaaaggtgggcttacaggaggaagctcctagctgtctgcacaggagggtagtactcagttgcatctgactgcagcactgaataagaatctcagggaccttggatatcattcagacccatctctcatttcaattgaagaaatcaagagtcccagattttcggccatttgcccgaggtgcccacctcaccagcagggtgtcctctacattctgtctaatgaatgaatggcctgccctggaacataagtagggcttccgcgttgttgtaggacagctttgtgttccagatcacagatgtctctttcataagccacacctcctcccactgctgtgtgggccacagctccggttagatgataactctttgactttttctcaaagtccctgaaatcagtcacagagaaaatggactgatcctttacatcaatctgagtgtccttgtgcgtgtgtttcattttgctttctattcatcctcaatgattgccaacctgcttgtgagatgtacctgagaataaccttcagacaaacgcagtgggctctgcattgatggtgctgattcagaacacatttggggtgttgtgtcatctgtctattagaatgcttccaaaggatgacgactcactgatagataatgttttgtttacaagcatgtccttgggtatgagactttgtagtgtcatgactgaccgtaaatctcactggcagtagcacagcatatgaaacaccttctgctctagtcattactttatgttcatcacaaacaaatcagaacaaattctgaatgcgaatctcctttcaagttagctgactcaggctgtcggaactcatgtaaaagcgaaccaaatatgacaggaggtgaaagctggccgtagaactggaaacggcagaacgtcattgaagtctgcctaagaactagtcagcatcccacctgcttgctcacagtcacactcaacatctctgtggaatttttagtgctcttttttgtattagtcttttagtcgttaccctagtgactctgatatgcattcctaacttatcagtttactttgaattaacattagaccacttgatatataatgtaagaacttcttacagtgtaatttcatgtacagacttcacaatccttttgttgtagctaaagtttacttctacctagattataaactccacaatactttgtcattaatgtactttatcaggtatgaagattcagttaattttaaataattttttaaaaagaaaaatactctttttcactctgatgcccaggctggagtgtagcagtgcaatcactgctcactgcagctttgacttcccaagcttaagcgatcctcccacctcagcctcccaattagctgggactacaggtgtgtgccaccatgcctgggtaattttttctacttttagtaaagacagggtctcactatgttgctcaggctggtctcaaactcctggactcaagtaatcctccccccgggcctcccaaagtgctggaattacaggcacgagccaccatgcccagcaagaaaaatagcctttatatttatctatgtattaacaatgtcttttacttgcctctccagtagatctaattttctatctggtatcatttcctttcagcctgaagaccccctccttgagcatttctcatgttatagacctgtcagcaacaaattctctcggtttttatttatcttaattttttttattatgccttcattttaaaaacattattttctttaatatagaattctagactgacaaggtattttcagccctagaaacttatcattccatgttgcctggtctcaattatccaatgacatgtcaattgtataagctagtttaaacaattcttgtcatttttattcaatatataatgttttttttttctttggctgacttttaaatttttctttcaacctttggacttcagcagatctgcttaaggtgtggttttctttattgactgagattcttgaatctgtgggcgactgttttaggccaaatttggaaaattttcagccagaatttcttcaactatttttttcttcttcattttctctcttctcttcatcaaggactacagataaaagtatatcagatcactctatactgtccctcagatcattgagaatgtgttcattcttaaaatctttttttaaatttgtgactcattttaggtaatttctattgattcgtgaccaaataaactgcttcttttgttgtgtctggtctgctgttaatctcatccagtacgttttttaaagcttcatctattatatatttcagttcttagatttacatttgctttatttttaaatttttcttatttttcttgaagttccccaattctttatcctaactatggatactataactttaaccattatatctattttttcctatggattctttatgtgcttatcatagttaatttagagtacttgtctgctaactccaatatcagaaatatttctgtaaaattattttttcttgactatgtctaataatttttagagtgccctggtcaaaataacttttgattgtatagtggcactgtggatgattcattgtaaaattttagaatccattatctctctttgaagagtattgagtcttgtactagcaggcaattaaattactaatgaatcaccctgactatgctgagacttgatgtgtttcatgaggatatgtctattttagttatgccatctctcagtcttgatacatggtatttattactaggagtggcccttataggttttcagtgaaaagttcaacatagttatcaatgccctctaacttcacgggactcatacttcaaacgctggctcttagcaacaggaagtagttgaaatctctgttaggctctttcagccttctgactgttggtttcctctagggctccttgactatttcccgaataaatgagcaggtcaggagtcaaccaaggacttgagaggagtttacgttcatattgtgcaacccctccttctatgtctctctcttttctagtatttcctcccccagtttccagctgctctggctgttctaaacttcctttctgactcctcaggcaaataggacttcaaaaattttttttggcctcagttctagccacccaagagatattattcgggaagtcctcgtaggggaaaaaaacagtgtgtatcttaaccaatgtcattcccttgtttgaagcgttaaatgccctctaattccatctgcatttggttgctttcattaacttgaaaattctctttctatttttccccagagtttataattgctatcagtagaaggcttaatcttatacaagcacttctaccatctccaagaccagagtgctccattggtttaatgtgtaaccatgagtgaacaaaattgttttcaaaaaatagacaaacctcactgaacctcaatgaacactgaaaagtaagaataaaggccgggcgcggtggctcacgcctgtcatcccagcactttgggaggccgaggcaggaagatcacgaggttaggagatcgagaccatcctggccaatatggtgaaaccccatctctattaaaatataaaaaaacgtagccgggcgtggtggcatgtgcctgtcatcccagctacctgggaggctgaggcaggggaacaggctgaacctgggaggtagaggttgtagtgagccgagatggtgccactgcactccagcctgggtgacaaagcgagaccctgtctcagaaaaaaataaataaataaaataaaaataaaaaaaggaagaaaaatgagaataaaaagaggtaaaacatggcgtttcatcttataaatttaaaatatacctgatttggtactgaatgattgtaactaagtttttaaacagtgttcatggcgtgactgtaaacccagctcacttttagaaaaacgtttttaccaacccaaacagtatcctactcaacaccagttatatttgtgggaagagagatagagttttctggggaaaggcccactcttctaagaaaatatatggttttctttgcattacttttccttctttattccctattcacgctattgaacatgtctatcccaacccttttttctggtcacataatccaggtctgaccacttggccttcttcttctcaatgtaattgatttaggaatgagtttgtggcccaaacaaatggaaagagatataatcctgggaatctgaatgaaataattggtaagataaagttttcttttcactgaggtagacagtagaatataaacttggaactggtatggccatcttgtcatctcttgaagacagcctgcctaagaatgaaaatcaatgctgagaaatataggacagagtcctgacaatgtcagttaaacctgaatccagcaactctgatagctatccctgattgcttagttatttgagccatttcattattgttaattgcccttacagcattttcagctgagttggtgttgtagaatgaacatttgtgtcctaccacaaattcatatgttgaagttctaacctccagtgtggctgtatttggacacagggcctttagggaagtaatggaggttaaatgaggtcataggggtggggccctgatccaataggattggtgtccttataggaagagccactgagcttgctttctctctccaggtgcacatattgaggaaaggccatgtgaggatatagtgagcaggccacctgctatgagccaggaagggaccccctcaccagaaacagaattttctggctccttgattatggacttctaggtttcagaactgtgagaaaataaatgtctgttgttgaagctacccaacctgtggtttttgctgtggcagctgagcagactaattcagttggggtcacttaaaactatgagtctccagtcatccaggaagtaggggtgcaaaggcagatttgtactgtgaccctgtcatggcaattcattctactggcaaaaatttccctcaattaaaacccaaatgatttcaaaacaccccataataggatcagcaagagactccaccaagactgaaaatccactgtgccaacaaaagccttctaaatgcacgttttagactttccttttaccttttcaagtggctcactggcaaaaatcaaggttctaattaaatctaaagggctatccaatcacacggttggcaccaattactcatttaactatgtatgtgttaagcataagctaattgcctttctctcaaaccagagccagttcagatcaggccattcaagagcatttaaacttggcacaagagggtagcactgaaaactgacaataaagaattctctcttgcaggagaacctttcaggaggctttcaatcaatttttgcaagttccaaaactcaaagaagcaaagctaactatgtagctggtgtatttctttctagatcttgaagcattaataaaaagatggactcatctgagaatcaaatatctggtgaaactatacataaatagatatatttgtgtgtctgtgttcatgtgtgtgcatgtggatatgtgtgtgtgtgtataattgcatgatgttcttcctcaccttcaaattctgacagattctaaggaggaagggcacagatgtgtttcctgcaaaagagccccgagtatcttttttcacctcccttccttccctttgtccagatgagaatctttgttttaggggaaatggaatttaatatgtaaaatttattctcagtgagtttcaccaaaataggaaccatatctctaaccttatattattattatctgtacaatacctgtcaaacggagcccccagtaaatgctgaaagcacttcacatccattgggaaggtgagtgcatttccctaacgtattttagagtataattaacacacagtgcctaacagagaaaatcatttttgtgtgttcagctaaacactcaactccacataagttgcatttgatatcgggttcactcggagaaatggctctcacacttgagcctgtgtcagaatcacctagaggggctgttgaaacagactgctgctctgggtcctttccccttcccctgggtttctgactccttagacttaagtgggggggtcccagaattacaatttttgtttgtttgttttttgagacggagtctcacactgtcacccaggctggagtgcaatggcgcaatctcggctcaccgcaacctccacctcccaggttcacgtgattctcctgtctcagtctcccgagtagctgggattacaggcacacaccaccacacctggctaattttttttttgtatttttagtagagatggggtttcactatgctggcaagactggtcttgaactcccataattagaatgtttaacaagttttctggggatgctgctgctgctggactggggaaccacactttgagaaccattggctaagaagctataggacaagagaggcagcttgccagcaggaaaggcattaagtgctctgctttctgggggagttttgcagtagttcacccactgtcaggagctacaaggctcacatccagctggtgtgagggcatcatgacttaaaagctacatgcctcacatctcttgtaataacttcatagacatagtgatgcggtttggctgtgtccccacccaaatctcatcttggatttccacatgttgtgggagggactcagtgggaggtaactgaatcatgagggcaagtttttcccatgctgttcctgtggtagtgaataagtctcattagatctgatggttttaaaaagaggagtttccctgcacgagctctctctctttgcctgctgccatccatataagacgtgacgtgatcctccttgccttctgccatgattgtgaggatttcccagtcacatggaactgtaagtccaattaaacctctttcttttgtaaattgcccagcctcaggtgtgtctttatcagcagcatgaaaacagacgaatacacagagcttgcagggaccccactagagatgtgccagttacccgagtcacagtctgagatggtcagagttatggcttcctttcaggtatttacaggtcacccagtacaggaatgacacccattagtaccaatcagggatcactttacaatgttgcctagtgacaaagttgaaacataccacctttgtatgtttgcagagaaacagagctagaaagataagatcaaattttcatgcagaaggggaaagaaagcattcctttgttaagcctttattcacaaggtacatatctttactcacattatgcccctattttaaaagcttaagaaatgtaaacattatgtcaaaaatttttcattcttggtttagctgaatctcaaagccaccagttggaaggatcatgccaatcaaggaagcagatggcttgctttgggcttcttcaacaaaatcacctagatcctaaattgctgtttctgtgacaatccatattgtctgtttctgttgcacatgataccacaggatttgctaatctctaacctaatttgtaaataggaagtaaatttctacttcagagcttctatcatctagtttttcttcacctgactgctatatggtctgcttcattttgttatgttgcttacttgaaaagaccatggagaaaatgtatttgttatttaaataaatacccaaatttgcaactccagatcttaactctgctaataaaagaaacttttaaaagaaacaatcttggcctaagtaaggaattcttacccttgttacataaacctagagatctaaagaagtaattattagccctggttgcattcacttaaagatctttttaaaaatactgacgcctgaaccatactgcaggccaattaaatcacaatgtctagagagatagggtccaggcacagaatgttcttaaagctccccagataattctaatgtagagccagcgttaagaacttttgaaactaaagtctatcactgagagaaaattatttttccttcctgtcacccttcctccccttctccttttttttaagaaagaaaatactgggaaagaaatcctaggctgtaattatgtgggttggttacagctttctttacaaacactcctgggttatcagaagaactgctctaaccttggggcaggtggactcttcctataatgacatgtaattattagtattattaatacttttgcaatcatattaataattaaggttcttttgcaataaaaaagagacatgggccaggcaggttggctcatgcctataatcccagcactttgggaggctgatgcaggaagactggcttgagctaagaagtttgaggccgcagtgagctatgtttgcaccactgcactccagcctgggtgacagacagagagagagagatgaaaggaagaaaggaaaggaagaaaggaagaaaggaaggaaggaagaagcaaggaaggaaggaaggaaggaaggaaggaaggaaggaaggaaggaagagagagagaaaggaaggaaggaaggaaggaaggaaggaaggaaaagaaagaaagaaagaaagagagagagagagaaaggaaggaaggaaggaagaaaggaaggaaggaaggaaggaagggagggaaagaaagaaagaaagaaaagaaaaaagaaaacaaaagaaggaaggaaggggaaaaaagaaagagagaaagaaagagaaagaaagaaaaagagacatgaatctaagctaaaaaattagacaaagattaggttctgcacttcagtttaaaaaagaagaaataagtacgcaaatctatcatttaatgagagcaaatatttatgtctccatgtcttaaaaatgcagatgtggcatagactggcgagatgctcacccacctgtttcctttcttcctgagcatgtgcctgaacatttcccagcttcctttgtccatggatatagtgacgtgactgagaatagtcagtggaatacgggcagatgtaaatatcacatccagagctggtcaatgaagcctacccatacatgactgtgatagttacttttatgtgtcagcttggctgggcgacaacgcccagataagtagttaaacattattctggacgtttctgtgaaggtacttttgaatgagattaacattcacatcagtgggctttgaataaaacagattgcctacaagaatgtgcctcatccaatcagttaaaggcctgtatataacaaaagactgaccacccccaactgaaaaaagaattctgtaggagatggccttcgaacttgaatggaaacatctactcttctctgggtttccaaagttctggcctattctataaattatagacttgctagcctccataaacataagccaattccttaaaataaatctttctttcctttctctctctctctctctttatacacacacacatacattttatactcacacatatacactttatacacacacacatagacatacccgtattctattggttctgtttttctggagaaccctgactaatacaatgaatttctaggaagaactcttaagaatgaagaaagaatttgggtttctttgttggaagtcctcttgccaaccagggacatccacatggacttagcatgaatgggaaataaactttcattgtgttaagctactgaaatttgtggttgtgattgttatagctgccagcattacttgatctaactaatatagcagatggtgaatgagatggttgttaatttccctttatcgctgacattctaaagcagtggttctcaaactcagctgtgcataaaaaaatcttaaagctttgagaaagtactcatacttggtctttaccccgaaattacgatttctttggtttctgaggtatagcccaggcactggaatttctaaattctctccaggtgattctaatatgtcaataatttgaagaactactgttatacaggatgactgagaccagagttaaaagttcatggataagagaaaccaagagggttctgttggtgaaaggcttcatctggatgaatggtatgattttctggcctcaaagcagagctcttgagctatataattatcgttattattaatagtaccaagaggatacatgcattatcttactaccttgctaaattctcacaataaaactcttccataaatattatgattctcacattttaaatgagagaagcaaagctcaaacagagattaaggtaacttgctcaaagtcacacagctaaggagtagagcccatgctcccaactctaacctgtaatacctcccattatcctaaagaaaatgctatcccacccccagccccccaccccctgacaggccctggtgtgtgatgttcccctccctatgtccatgtgttctcattgtttaactcccacttatgggtgagaacatgcagtgtttggttttctgttcttgcaatagtttgctgagaatgacggtttccagcttcattcatgtccctgcaaaggacatgaactcatcctttttgatggctgcatagtattccaaggtgtatatgtggcacattttctttatccagtctattattgatggacatttaaataacatatagtttcccaagccatttagcaggagaacctgctatagatcgagaaccactataattgagaaccactgctttagaatgtcaacgataaagggaaattaacaaccatctcattcaacgtctgctatgttagttacatcaagtaatgctggcagctataacagtcacaaccacaaatttcagtagcttaacacaatggaagtttatttcccattcatgctaaggccatgtggatgtccctggttggcaaatgtcctgatttgccaagatttgtcctgataaagaaaatgtcctgatcaaaataagtaagaatcacactgtgcaacttgctgctcagatacctgaaatattgcattcaattcccagagtcccagtttaaagaagaagatagtaaaattgtgttcagagaggagcaagtaggttgttggaaagcctggcaagcacgaataagtggaagagaaaggaagggttagatcccagaaaggcaatgctaaaaaagaaggaatgattaaagaaagagaacataatagcgcattcaaatattgtaaagtttgtcacgtgaaagaggaattagcctgttctccctttgtccagagggttaaatcaggatcataaattagacattgcaaaaaaaaaaaaagaaagaaaattctgtttggtataaagaagaccttctaataattagagcttttctgaaaactagcagggttgctaggatttaatgagaaaatatgttctgtaaatgcgtataaaacactgagtatttttgttgctattatcatgtaggtgagtgttccattcattgaaatgtgcaggtacatactgaaatggtggttctgcacaagataggaataagttagatggtcattaaggtccattctaatcctaagattttatcctcacatatcttgggtccctccaaaaaaaaaaaaaagtgttttataaaatgtcttgtctaatgactggttgactggtgaccaatatatatatatataccatatatatatttctttaatttattttttaattatactttaagttctggggtacatgtgcagaacatgcagttttgttacatagttatacacgtgccttggtggtttgctacacccatcaactcgtcacctacattaaataattctccaatgctatcccacctcccagccccccacccctcaacaggccctggtgtgtgatgttcccctccctatgtccacgtgttctcattgttcaactcccacttatgggtgagaacatgtagtgtttggttttctgttcttgtgatagtttgctgagaatgatggcttccagatgcatccatgtccctgcaaaggacatgaactcatcctttttgatggctgcatagtattccaaggtgtatatgtggtacattttctttatccagtctattattgatggacatttatataacatatattttcccaagccatttcgcaggatatgcagtctatttcttcccaccataaaagttaaagaaaatctacagcaataatttggtcaattgtggtttactgaaaacttactaggaggctaactttgagatattcactttacttgaatataaatatcacgaagtacatatagtggatagagtacttcctgagacagcacgaaggcccatgtctgtcccctttagctcctcccatagtcaatcattgtgttgagttgttcagtctgcattgtctcatcttctccatggcaagcttttctgaacaggtccactacgctttggtattctctccacagtatagctcagtgattgccacaccacagatgctcaacaaaagtttgatttggagatgacctagaccctacaaaagttgtctgtggtcctgcactcacagcatgataactgagggataatgtacaaggaaaaatgtgttttttttttcttttaaaaaaattttatataaatgtaagggatacaagtgtagttctgttacatggatatattgcctagtgatgaagcctgggctgtcagtatacccatctcccaaatagtggacattgtatccgttaagtaatttctcattcctcatcccccttgtaccctcccacttttccaagtctccaatgactattattccactctctgaatccatatgtacacattatttcactcccacttataagtgagaacatgtggtaagcaaaatacatgttagatatatctctgtaatgaaaggaaaagtaaaagaatcagtcttaaactactgaaataatttatgcatttctcccacatgtggcaaatatatcaactctctttaggtataatatacctgacctcattgctgatagcataagagctttaaacaaatacttattcaatacttagctttttctctcataaaatggaacaagatatactagggtagagaggacgcttctcacgttcactgctgtatcctcagcacttggtacatagtgtttgcatcacaaatactggctggatgaatcagtgaatgaatgaatgaatggggaggctatggatgtgaaatgtttgatatgccttttagagagatattacaggcctttgagtgactatgatatttccaccaagcttctcttttgagcatataacttagtaagtatcttaaagttcatgttgacagagagggtgaaagtatgaatactttcttgagcttggttatttctaacttgttaggtacagttatcaacagtgataacagtccagcctgagctagatataaacaagaactgtatgccagctttcaaattgcagtttccatgataagctggctctgttttgctgccactgaatagagtgccatttagcagtggtgagagtaagaaaaagttgatcctttggtactaaacagttgagacctactcaagggagctgacattttcaacaccacttgaaacttgggcttggagccaggagaaagtttacacacaatcaagagggcactgctgcatctgcaaaagcagtttcctgtagctagatcgtaaaccaagagtgatggagatgagagcacccaagttcataaaaattccctaatatgttcatttgtaaaagaagaaaacaacattggccaaagaaagatgttctcctagaaaaaggaaaagaaaaaaaggaaatccatcttaccctctaggtgaaaaacacaaataaaatgtccgcgggaatattaaatgcttttccaaaatgtgcaaaacaataagcttcctactgtcctggtgtgcaacgtttgagaggaggctggaagaaggagcattcttgtctatgggcacctgcttctgccatgctggagagaaggcaaatctcaaagggtctggtagttaggatgattggatagagtgatatctctatctcagtctaaaggattggaagtactacacattcttccttcatacagtccaccttttctgagcacctgttagcagccaggcagtgtagtaggaatgaggagataatcagttagccagaccacccctgcactcatggatcttatacaaaaacagaggtaaaagacaatcaacaatggactgattccattacaatgatggtgttagaagaagaaatagtactaggaatttacatagtggtgaaatctgacctacttcattccatgagcaggtgacaccgagctgaacattgatgcataagcagaaactgacaaaaggaagccattgccaccattgataggaataagaaataactatttcccaaattctttatgttatcaaattattctccacacaggtgttttggctttgcttttttaaattctgaagtctgaagtttcagaaactacattgtaattgaaaataggtactcccctctttttttctctgatgctttcattaaaaattctcatcatctttttatgttacttattcggaccttaaaatgtataaaaatatgtgtggtttttgctttcagaaggcacacttgggatctgaagcagcaataattatgaactgacaatacgaaggttggctggctctgatgaggaactccaaggaccttaaaattcacttatgtcaagaggggaaaaggaggaatctaccatagcaaaataagacccttgtacaggatacacccacgtgcacacgtgcactgagagaaaatgagagttgtagggggctgtaggatcctgactgtctcatgcctacagtgagaggttcatagagattaaagagattgctcaggttgtccagcttggaagtgacaaaggctgggagtgctgaatactggaatgtaatggaatccatctacaggtaaaaagcctatggcaacaattagagggagaggtaaagtctctgaggcggcaggcaattggtacggagcctgaaagcccaggacaaagttttatttgctttcaagagcgaataggctcacacctataatcctagcgctttgagaggctcagatgggaggatggtttgaattcagaagttcaaagccagcctgggacacacagtgagactctgtctctaccaaaaaaaaaaaaaaaaaaatagaacaattagctgggcatggtggtgtgcacctgtagtcctagaagctgagatgggaggtttgcttgagcccaggaggctgaggctgcagagagtgagccatgattgctccactacattacaccgtactcctaggtaacacagcaagaccttgtgtcacctccagaaaaaaagaaaaagccttaacaaacagaagtgaaggtaccctgagggaatattctatttggctggggactccttatcatgattttacttagtgttgcagcatattgtgttttctgaaggtaggtgttccccctcaatctttctcatcccaccggcccttctccaatgtgaccttgccattcctccatcaagaagggaactctaacttgcctccctcttcagatctaggctaccttatgagttgctggtagccaacaggaggtggtggtgaaagtgacactgagtgacttctcaggctatgccagaaaagccatggggcttgtgcttgattctcttgggacactggctctggggaagccactgaccatggaggtgactgactagcctgacgctgctattttgaaaaggccacatgttgatgctctagtcaatagagtatcaggtgagcccagcgttctgtccaccccggccacaatgccaaaacacgtgaatgaggaaatcattgtagaagtgatctcctcccagccatttacgtttccacctgagcccctagaaatcatggagctgaaataacatgccctgtctaaattgctaacacacagaaacggtacgcacaacaaaatcacataaatatagataaaatccactaggttaaaaggagtttgttacacataaaaaaaatgactgaaataaatgttatattatctatctataaagactactatgggcattgagcccgctgaacagataagaaacccaaggtacagagagataaacccaactagatgatagaatcataagtagaatcttataaatgcagcaataaaatgatcataaaagtacatgtgaggacactgagtttcatagaaaaatgacttggatccagatgcacagttaataaaggcagatccaggaaaagaacttagatttcctgaagagtgctggagtctgaagctctttccaaaatattagatcaagcacggggtagttaaaaaaaaaaatcacatgctttggcatcagatctgggctgattatatccctgaggtaagtttactttatgcctggttgcccctatctttaaatagaaagaaaacagagaaagaaaaatatgaataaaacaatgaaatttggaacaggcttgtagtttaataggatcgtactaacgttaattacctggttttgattattcaactatgattacataaaatgctaatagcagcagcagctgagtgaggggtaaataggaaacctctgcactatttttgcaactttttgtaagtctaaaattagatcaaaataaaaaattaaaaaaaaaaaaaagaaggaaaaaccatacctaacttgtggggttttaaaaaacaaatttggaaaatgcaatgcctggtactttaaaaagatttcagatataattctcctctgcttccctcattccaactttctgataaagccagaacagatggcccacggacttctggttcagaccttgctccccaagaaaaagtcccctcatactgcaggtatatgccagcactttgcagctagaacacctctcagaaaatgaatcgaggaagcagacgatgggaaacttcccacggtagtgaaatctctaaacctcttctctgacctttgaattcttggcagccacaagctacgttcttgccaagagtcctcacgcgtgtagcttccacatctcctcgccctcatttagagggtagacttcctccacactccagtcatccggtgccatctgtctgtggccatgaattagctgaaagctctccgaaaccgccttctcaagctaattgagctgctctaaatatttgaagagacagaaatggggttataccagagatggtttaataaaatattgaaagagcttttttctaacggtgtagtagtccacttccttctttcctcccccagggaaatatgcatcttatcagtttatcatccgaaatgaacttgactggtctgggaaatcggccacaccgtcaggggagagtgaaggagaaacttccgggaaatgatcagaactattttaaaatcattttgctagtgcaaatcttgaacattcataaaacttatctatgaagataaagactgaacataaagaatagcaatgggcttggcctcctaccttaaaaccatagagattgactgtgttaaaatatattgttgaggatctgtaacaggaaacagataacctcggaagttcagcgtgaagggctactgcaccacagtcagcttctggctacaagaggaggagtccatcagttcacaaaaccaatgacttccatcaatttatatttaagtttttttttttcactgaataattctgtccttctaatataaatctgacttttctaaccttgccttatacttcttggaaattcctacttaatatgagtccatataatcagaaaacatgatgaatttggggcacaaaaactaatttttatttatttatttatttatttgagacagagtcttactccatagcccaggctgaagtgcagtggtgtgatctcggctcactgaaaactccgcctcccaggttcaagtgattcttgtgcctcagcctcctgagtagctgggactacaggtgtgtgccaccacgcctgactaatttttgtatttttagtagagagagggtttcgccatgttagtcagtctggtcctgaactcctgacctcaactgatctgcccaccttagcctcccaaagttctgggattactatcatgagccaccgcacccggccagggcacaaaaactaatttttctactaacagttgctgggtatgccatggggcccatcaacaatggagcccactttgactcacagttctgtgctctgagtgagcaaaaacattaacctcaaggcctgtacaatgcctgagcattttctgaatcattaagtacaatgacgcagggaaagagaggacaggaagaaggctgggaccaggcccccttcaccctagtgttctgtcctaggaccgtgagtacagctgcagtcttaggtgtgcttgtagatcgggaggaggcaggaagcttgggaaggaaacagacactttggttgtccccatattgcttctggacccctcatggtgctctaagaaggagagagcaaatttgtctactgagagggacattgtagtggacatcaagatgcaagttagtgctttataaatttatatttcctcatcttttcaagttttacctctgatcatgataactcttttggttgttggtcgtactccctcctgtttcccttgactagtctagaaatccctcctccctaagttctccacccttttctccttttcttcaggccaaaatgttctcaagttgcctttgatgaaactagatctgaaatgacttctagttgattaatttgttcatacaatatactgtgaaactgggcaagagatgatataaacactccttgaagctagctggggaggactctgccactgttttttcattttacaaatgaaagagcctctatttatggcttttgatgacatagaatagtctatttgataaaaattaatagtaccccctctagttctaataaaaaatttatttattataacaatatctttataaatgtggagtgtcttcctcttaatgattttctggaactctagtggtaagatcacattttgattaaccatgcctggctaatttttgtatttttaggagacagggttttgccatgttgggcaggctggtctcaaactctataggcacgcaccaccacgcctggctaatttttgtatttttagtagagacagggttttgccatgttgggcaggctggtctcgaactcctgacctcaagcgatccacccaccttggtctctcaaagtgctgggattacaggcgtgagccaccatgcctggcctcttttcccattttctaattaatcatttgtcttattgagttgtaagatccctctgtgcattctgaatacatgtctttatcagataaatgatttgcaaatatttcctctcaagatatggcttggctgttttcttaacagtatcttttgaaaagcaaaaggttttaattttgacaaagttcagtttatcaatgtttcttttatagattgtggttttggtgttacatctaaaaactcattgcctaactcaagatcagaaaaattttctaccatgttttcttttagacgttttataacttttgctcctctgtttagttctattattcattttgaggtaattttatgtatagtgtaaggtaaggatttaaattcgctgctttttgtatggatatataattgtcccagcactatttgtttagaaaacaatgcttaccccctttgaattgcctttacacctatgttgaaaaccaactgaccatacatataaaggcttattttgggatctcttaattctgttccattgttgtatatgtctattctctctctctctctctctttctctctctcttttgagatgccagagtgcagtggtgagacaatagctcactgcacccttggactcctgggcttaagtgatcctcccacttcagcctcctgagtagctgggaccacaggcttgagacactgtactcagctaattcagctaatttttaaatacatatatttttttttggagagaagggatctcattttattgcccaggctggtctcaaactcctggcttcaagcaatcctcctgtctcagcctcacaaagtgttgggattactggtgtgagccactgcactgggcttatatgtctattaagccaaaaccacattgcctgataaatgtaggctggtcataaattttgaaatgagtggtgtaaatccgctaactttcttctttttcaaagttgcttggctgttctaggtcatttccatttccatatatattttaggagcagtttgtcaatttctggaaaaaaaaaaaaaggcctggggggagcttagatagggattgggttgaatctgcagatccactgcagaacgacagtcttaactacatagaatcttcctatctgtgaacacgtaatgtctctccatttctgtagatctttaatttttcacatccatgtttgtagttttcagtgtgtacttcttgcacttcttttcttacatttattcctaagtgctttgtactttttgatgctatttttattgttatattgtccattgctagcatacaggattaaattattgtagttttgtaggtcattggcttatataaaaaaaatcttataatctttttacaggaatcatatggtgacatgaaaagggttccataatatagtccccacctgctactccagcatcactccccagcacccgtaagtcagaatgtatgtttccctagcactgaacttctaaaaattgatacatgttagatgtccatgtgataatttcatacatttacataatcaaatcaaggtaacttggatatccgtcaccttaattatttatcatttctttatgctagggacattcaaattattatcttctagttattttgaaatgtccaatcagctaatattaactctagtaaatttactgatctacggaacaccaggtgttatgtcttctttcaagctgtgtatctgtacccattaatcaacttctcttccctcctccacactgccattcgcagcctctggtagccaccacactactctctatcttcatgagatccactcgctagctctcacagtctcacatatgactgaaatcatgggatatttgtctttctgtgcctgactcacttcccttaacataatgacctctagttctatccaagttgctgcaaaggacaggatttcatgctttttttatggttgggtaatattccattgtgtacatctaccacatttttcttatcctttcacccattgatgaacacttagattgactccacattttggctattgtgagcactgctgcaaagtacatgtgagtgaggatatcgcttcaatatactgatgtcatttcttttggatatatacttagtagtgggattgctggatcatacggtagttctattttttagtttagtttttttttttttttttaaggaaactccatactgttttccacagtggctgtactaatttacattcctactagcaacgtatgagggttcccctttctccacatcctcaccaccatctgtcattccctatctttttattttaactgggataagattatatctcactttggctttgatttgcatttctttaatcgtgagcactgaactttcgacagtaccctgcaaccttatgatgtttttacttaaatttaatttcaacctcaagtctcagtttatgcattacctcatcctagaagcctttcccgttttctctctacttgcgctacgctgcatacactggggaacgcatgtgtgcatggacactgtcatttctataccaaattttaaactatactaaattttaactaactacttacatgttcatcttgagaaacctgtgtcaccatgtatagcaaaacctgccagttgtttatcgatatccatcttctctttccaaaacaatagaacccctaattttttgctaggcataaagcaaaagaaataaagaccatatttctggccccgcttgccattaaatgcagtggtacgattatcttgcatccagtgagagaagctcatcgggcagctcccagaaaccttccctcaaaaacagccaatgcatatcttgtttttctttttctttttttctttttttttttctccttcttgccagttaaaccagatctgctaaatgaggctagaccagccaccctgagtggatgaagtgaagtgactgtgggaacagagacccacatggggcaaagcaacaataggaggggagcctgggtctccatatcccaccctggtctgcctacttctgggctttccatgagaaagacacacaattctccctgctttaggctgttatttccttgggtctctcttaactgttgccagacttagtcgaaagaggtttataccacatcctattgcatcttcagtacctggtgctgtgccaaacacatagtagttacttaattaatgtttgctaatttactgcaaaaggatagcaaaagttaaaaaaaaaaaggaaaaaaagctttatggaatattaccttcaaatccatcctgctccacatggttaccaaatctctttccaggataataaaatcttaacattttaggcatacaatttggccttcaaaggcctctcagctttttaaatctaatttctattctaatttattcatcatgatgttaataagatgtttggtttttcatgtagaaggaaaagcaaatttatacaatgattccatggatagtcaagagacagaaggcctgtaattgactataataatagatctcacaaaatcataaaactgatagtaacaatggggttcaagcaattaaacaattttgattccacagatgaaaaagctgatgttcagagaggtgacacaactaattccaggccacacaaacattgaatggcagatctgatgtcagaacccagataatctaacttccaacttggtactctcagaatcagttagagtgcctttggttgtcaagagcagactaactaacataagcaaaaatccttttaaaatcttagaatttacaggatccaaagcctggaacaggcaggaaccaggcagctctgttcctgcctggtttccatggcaacatcagctacagagctcatactgatttagctgacggaatgaatgaataaactccaacaacggttattgttctgtttttcattctgattgtagaatgcttctttttcttttcttttctttctctttctttcttcctttatttttctttcttcctttcccttttctctcttttttcttttttctcattctctctttctttctctttctctctctctttctttctctctctctttctctctttccttctctctctcccttcctttcctttccttctctttctctctctctctctctcttcactcctttccaccattatttttgcttactgaatctgcttcccagaacagtggctgatgagaagcctaggcaccaattttctcattcccatttccctcaacctaatatagggagtgagatacaagggtgaacccctaggagatgcactttgagagagagagagagagagagagaaagacagacagagacagaggagaggagagagtaagagttagctctctggctttcctggcttcctctcattttctgtttttatatgcattttatttgttcacatgtttttaaagtctgcagtttgagaccatgagatgacaaggagagaactgaaagccaaacttttgagaatacttaagagaaagttaccaagtgcctgagtcttctatgatatcactgagcaaatgacgacctccgccccccatattttagaaacaaataactgaatgcatgaataccgtaaaggaagatgagtacatacatgtaagcacttagagaaatgagaaaccaccttgtatttttatctggaaactaataaaaagcaaaatgcatccaggaatattatacgacatgcaatttcgcaattcaaggtttttctctttcagtgtgtagagttagccataaagcaaattgacagatactgaatgacctagttaaatcttccacggatgctaatatctcctgttaacaccctgcagcttgaccctaaggacttccgcgcacccatcacatgtatagtatggtgtttatttcttgattttatatttttaatatataaacacattggttatggacaggaaagaccttctgtcttattaaatgactcacatgatttgcctcgaaaccacaagctaagtcaaacttgtgctaagcatggtttaatctgacagaatataaagattctaggacaaatcaaacccaagtgaaagtttccagttttattgccacacccaagttcgataaagaagcaatatgagcttgaattaaacttgcagccgagaaaggttacaacttgaatatagtattgagcagaaagaaaactttccatggatcaaggactcaacataattctaggatctataaaaaaaatatccatctgatcttcaatgtgtgtacattctaggagtaaaacctatgctttgttaatattacaaagtaaagcaatcttctttcttcccaacagcattgctttgcccattttagtctgttatgtagcattatccatgaagagcacgacaagggaaatgtacagcgagcccttgttaatggtcttcggagaaaatggtttaattgcacagacaaatgctgagtcaaaggtgattgtgcaagccagagaaggaagaaaagaaaatattttttaaaattagccaataatccatttataaggacaacaaacaatagaagcttaatgactttttgccatattactaaaacatgtaagaattacacgtgacttctggaacacaaaattcttaatcccaggtcagaatagttaattcaaaactaatttgttttcagggaacatatctgagaaataataaaatgtagggtctcagctcacatccacccttgctcagatgaatgatcataaaaatggtcctaggcaaggccacagggtctggctggctgaggactttgtgcactggaccatataccatgagcagtgagttatttcaaactccagctatggggccagaaactccttaggagtccgcaccagaatgtctagaggagcacgtatattaacaagcatattttacacttaaaaaaaaaattaaccacagaaactgagattccaccagacttccttgataggaagataaattgtaaaagttttactgaaggacttaatttttaaaattaagccatttaatttaaaaaaataagacttttaaaacaatgttgagaaacacacccttcaccagaagaagaaaggggcgtggccagggaagcagagcagttccgcctgtacctggtttatgcagtgcacttctgaatattgccttcgaggaaaggttaggacaggataaagcctccagacaccaccgttcgagtataatttgagccaggaaagctgtcagtgcagctttttactgtgttgtagaatcctttgggaaagaaatcttttcttgggttcctctgagaattccgactgaggcaaaaccagatttatcagggattttgcagatatcctgaaacaaaccgtctctcagcgtgagtctaaaactccatccgccaagaccgtcgctgggactaagccctgaagctgagtgatcacttgcttcctctgctcctctctcgtaagaattccttccctcaaaggcctcacaggctagatagggaggcagacacaccagagaaacaacagtgaagcatgcaaagtgctgtgaggaagtgttgtgcaggtattgtagaagctcagattgggagtgcctagggctgaccgacccagacagtcttttatactgggcatgtgtgtgtgtacatgcatatagaaatttggggaggagaagaaaaagaaataaaaggaagtaatagtggctgcaacttctgcctacagatactatgaccttgtatagataatgcttttgtgactatgacttggccttgcttgcaacccaccatctgagtcctgctaaccgaggaccaactatttaggaacaagctacactgtgccaccaaaacagacatcaacaacacctttattacatacacaattgccccaagaatttttatatatactattttcctttgcagcaactttactcaccctctctctcttttttcttttaaaatttttagaggagtttcactctgtcacccagggctggagtgcagtggtacaattatagctcaccgtagcctcgaactcctggggtcaagtgatcctcctgcctcggcctcctgagtggctaggattacacatgtgtgtcaccaggcccggctactaagctactaaccctctcttaaatacaagctactaaatctattgaatgatccgggaagaaacaatatgaaaaataaaaagataattaagaatttcacaaagcaaatatatgtataatgtctagaagaatcaaagatggaaagataatatggtaatatgacactaaagagcctgatgaactttttgatttgttataaaacatttaaaaattttccttcaatatttaattggccaatgagtctccaaatagctattgcctctctctcttttttttttttttttttttgagatacagtctcgctctgttgcccaggctggagtgccctggtgcgatctcggctcactgcaacctccgcctcccgggttcaagctattctcctgcctcagccttctgagcagctgggactacaggtgtgtgccaccacgcccggctaattttgtgtatttttagtagagacgggtttcatcatgttagccaggatgttctcgatctccggacctcgtgacctgcctcccacggcctcacaaagtgctgggattacaggtgtgagccaccgcgcccggccatccctctctctaactcttaatccacattgccatgcattggttccctgctattaacctctttggttctaatctagatgatggcatctgctggtcagtgtcctggtccaatgtggatcccatccagcatgctctccaccttacatgcagagcagtctttgtaaatcacaaatctcatcatgtccccccttcactcaaatgcttagatacagcctttcaggataaagtccaaactttttagccgtctataatctgactcttttcttgttacttgctcaatttgggacatgtactctggacaaatgaactgtgtcataccccaagcacgccatggtcttgtgtgccttcatcttttttactctccactccttaccagggatgaactgcctcccattctcagtctagatccgtggttctcaaggttctcaagggaacagtggcgacagcagcaaacgggacatgtcagaaatgcaaatgatcaggcttcatctcagatctcctgagtcagaaattctggagaatggaccagcaatctgcaaataaggactatagaagatcttataccacagaaaagctaggcagcgtgcagagaactagagggccatcgatgacttctttgcctgcagttcagcaaatacacagcagaagtgaagaccactaggtcacttggtcaagctattcataaaacagaagtggctcaaggagaataaatggattatacgcagggacccctgtagcttgaggagtcagatagacattatagaaacagagactgtcagtgtcccaggggtccaggaggtcaaatagtccagtctcatcatgtcacagaggataaacaggagtcctggaaaggtgaaatgacttactcagtgtgagacagatggccaagagaacactgaaaccaaagtgttttagaaggaaaaagctgcatggtaaaaacagctgagtcatctgatggacactgacacaggcaagtccctcggtgggcacccaggcagaatgagaagcatgacatgtttgttcttaataactcagtgggctgatcctgcagtctaggcaccctgctgacgggaagaagcaacgactcagttagactcacgtggatctgtccagcactggacgtcagcagtagataggtttgatggagctggaaagtttatcctttaaaaatggccacaaatattacacttataaatatgtatgtgtgtgggtgtagaaacattacttgtaaaaaatgaaacctgttagattagatcaaactaggttgccgcttctaaggtagtgaacgtgtaaaagagtaaacctcatagaaacatgaggctgcccaatgcatgtgtacatgttggtgttgtgtgcatatacttcatcatatacatatagttagaaattgtatgtataattaaaaatataatcattcaatcataacattaaacagtgaaattattacatcataatgttaatcataacatggagcaattaaactacagtgttttatgacatatagttttaaattataacattaaaaatataggtaaacggctaggatcggggagcaaatattaaagtaaataaatccctgccctactccctgagccctttctgctcatattttgcactcttctgaggactgatgttggcctcccaggcttcaggacaacctgacatcaagatgcctttaggttctttctgacagctgctgctgcttcttcatcacagagagttcatttgctctcctcggcaggccagagctaattaagaagagaacagcccaggttcaccctcccaaccctcctcatcggctagaactgcctgtttgctgccctccaggtcttctgcagtgagaccccctgcttttctccagagagtgaggaaaccaccactagaggggtggggtctcaacacagacatatttacccaacaggagcagaatgtttccatttgacaattccactacaagaagcaggccttcttggacctcttgcccaacttctggccttctgattctaagtagaagttgtcatttttctatgactactattaggttggtgcaaatgtaattgtggtttttgcaatgaaaagtaatgacaaaaaccacaattacttttgcaccaactagtgctagcaatgccttaaaaaataaattgggctcaagatttcttggggcataaattgttttgtgctgttttccgtttcatctccatgttccacgggcttaaacaccacagagcaaaggcagcacgtgtctgtggagctgccccctttccaaggaagctgctttgaccttcaccttctgcctcctggtagtgtgtgatgatcacatggaatagtaaccagagctgtgtcacacttcacaaaacaccttggggattttgtgacctcaaagtattctcttcacctggcaggtggcatgagccatgggagatcccgacactcccaactttgctaccaatgactcagatagagggacacatgtatacatgtgtctgtgcacattaatggaccagcactggccatgtttctatgaggccttttcttttacatgattaccatttaagaagcagcaggtgaatctaacctattttgttttcttacaagtaatactgtgttcgctttttgaaatttcttttctgaactttagtaaaaccatttgctactctttcactctctttttgtgtttttttttttaatttttaattttgattttcataggttttgggaaacaggtggtatttggttacatgagtaagttctttagtggtgattcatgacattttggtgcacccatcacccaagcagtatacactgaacccaatttgtagtcttttatcccctactgccccccaccctttcccctgagtccccaaagtccactgtatcattcttaggcctttgcgtccttatagcttagctcccacttataagtaagaacacacaatgttcggctttccatccctcagttactttatttagaatatggtctccaataccatccaggttgctgctgctgcaaatgccattattccgttcctttctatggatgagtagatagatagatagatagatagatagatagatagatagatagatacaatttctttatccacttgttgattgataggcatttgggttggttccacattttttgcagttgtgaactgtgctgctataaacatgtgtgtacaagtatctttctcgtataatgacttcttttcctctgggtagataagcagtagtaggattgctggattcaatggtagttctacttttagttctttaaggaatctccacactgttttccatagtggttgtactggtttacattcccaccagtagtgtagaaggtttccctttttaccacatccctgccaacatctattattttttgattttctgattatggccattcttgcagaaggagtaaggtggtatcacacggtggctctgatttgtatttccctgatcattagtgatgttgaggatttttttcatatgtttcttggccattttcacatcttcttttgagaattgtctattcatgtccttagttcactttttgatgagattgtttgttttttcttcctgatttttggagttccttgtacattctggatattagtcctttgtcagatgtatagattatgaagattttctcccactctgtgggttgtctgtttatactgctgattatttcttctgctgggcagatttttttagtttaattaagtcccatctatttatctctgtttttattgcatttgcttttgtttttgtgtgtgtcttttgtttttctcctctcccactcttatccccaacccaactttgatttctctctttattctctagaacgtgaattaaccagcagcctgcatttcacatttaactgaagaagcagaattgatgagtgtcacctgaactatcttgaacatttcatgtcacattgcatgtcagatatttaatcttgacacctcctctccgtccagagccaaaaagtcaccaggaatgaagaattctttcttcatcatatagaattttgtaggccatggaaagcaatctagacattattctaagtgctatagaaaactgtgtttgagttttgagcaggaaagtgatatgatttgaattctacttaaaaactcaggctgggaaatagaagaatgaaagcaaagagaccagtaagaggatttattgcaagaatgaaaggatcacatgactatgggggagagaaatggatgaatttgggatatattttgtgtgcagccaacaagacaaaaattaatgcttgcaaggaggggaaaagaggcatgaagggaaagagatggatcaaagaagattcataggcttttacttgagcaactaaatccttgcagctgccctttaacaaaatagggtacagagggataaaggaaatttggagagagaaggaataaaaagttctattttggccacattatgtttcagatacctactaaacacacaaatagaaacgaaggaaagtggtcaccttattttaatgggaaggcagcaacctgaaaacctagtcatcctggagcatccagcagagaaaatttctattgcaagaagtaaacacttgattttgccttccagacagatcatttcattattcaaagaacattttttttcagaaggaccatgagatatgcaaatatatagcagagatttttcagggtacacaggtgttagaagctaaaagtagtggagcaaggtgacaaaaaagagatcctttctagcgggcagtgaaatgcctatatattattttctttagagcaagattccctttccaagtatgaacttaaactgacctatccaggtacatattattattttcttagaaaatgtgtgtgtgtgtgtacacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccaccaaaaagtgggcaaaggatatgaacaggcacttctcaaaagaagacatttatgcagccaaaagacacatgaaaaaatgctcatcaccactggccatcagagaaatgcaaatcaaaaccacagtgagatatcatctcaccagttagaatggcgatcattaaaaagtcaggaaacaacaggtgctggagaggatgtggagaaataggaacacttttacactattggtgggactgtaaactagttcaaccattgtggaagtcagtgtggcgattcctcaaggatctagaactagaaataccatttgacccagaaatcccattactgggtatatacgcaaaggattataaatcatgctgctctaaagacacacgcacacatatgtttattgtggcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaagctggaaaccattattctcagcaaactatcgcaaggacaaaaaaaccaagcaccgcatgttctcactcataggtgggaattgaacaatgagaacatatggacacaggaaggggaacatcacacaccagggcctgttgtaggttggggggaggggggagggatagcattaggagatatacctaatgttaaatgacgagttaatgggtgcagcacaccagcatggcacatgtatacatatgtaactaacctgcacgttgtgcacatgtaccctaaaacttaaataataataaaaaagaaagaaagttggacttaagaactgtaaaaatgcaaggtgatataatttggatttgtgtccccacccaaatctcacatcaaattataatccccagtattggaggaggggcctggtgggaggtgattggatcatgaggatgctttcttatggtttcgcactatccccctagtgctgtcttatgacagagttctcaagagatctgcttgtttaaaagtgtatagcacctccccacacccccctcctcttgctcctgccgtgtaagtgtgctcacttccccttcgccttccaccatgattgtaagttttggtgatgcctccccagaagcagaagcttgcacagcctgcagaaccatatgccaattaaacctcttttccttataaaaaaaaaaaaaaagaaaacgtgtgtgtgttcaggcctggcacagtggctcacgcctataatcccagcactttgggaggtcgaggtgggcagatcatgaggtcaggagttcaagaccagcctgaccaacatggtgaaaccccatctcgactaaaaatacaaaaattagccaggcgtagtggcaagtgcctgtaatcctagctactcgggaggctgaggcaggagaattacttgaatctgggaggcagaggttgcggtaagctgagatggtgccactgcactccagcctgggcaacacagcgagactccacctcaaaaaacaaacaaacaggcaggacgcggtggctcatgcctgtaatcccagcactttgggaggccgaggtgggtggatcatgaggtcaggagatcaagaccatcctggctaacatggtgaaaccccgtctctactaaaaacacaaaaaattagccaggcgtggtggcgggcgcctgtagtcccagctactcggaaggctgaggcaggagaatggcgtgaacctgggaggtggagcttgcaatgagctgagaccacgccactgccctccagcctgggggacagagcgagactctgtctcaaaaataaataaataaaaaaccgaaacgtgtgtgtgtctgtgatgatggggtgtggatgaagactgggcaagctatctcaaaggcaatcagaaattgacattccccccaaaatccaaaaatagcaggaaaggtatgtaggccacagagtctgcttgagggtgagatataattatagaagggaaggaaacctggactgataaatctatctgtctttttccacttgtcatatatataccaatgcttcactactaaggtagtgaaccgtgatagagcatggttgtgaaattgaaatcctgggaccagaccatgtccctgcgggtagaaggtaaaattccttccaaaggaagtagatatttttactgtctgtgttccaatggagagatccattccagtactaatacgaagtttaagaaggcatgtgttaaactagaaaaaactgaagatgaaaagaacacagcttcctcctaagagacttagaggaagcatggctctggatttcgattgagtactatctacctgtgagtagtccttcgggggtaggcaaagtggattctgcaataaggcattaggccagaagctaagggtctgggtatgttggctttaatagttaccatatctagttgctattataaattgtcctctttgttgtttttttttctattattgaacacactgtaaatcttgtagaattagaggcccatgcttggatgaaacatcatgggggagagcagtagcagtccaaagggagccatttcaggaagtaggggatacatgaacgtcagctgtggcccttgcgcagaactgagagtgctggctagctgaggaacacagcagcaagggaaggaattagtttaacagttaccatctcctagaaactcccagaaatacacagaaagaaaattttgcaaaagactaaaattactgcattcaagcaggagggaggctgggaccattgtacatatgttctttaaaagggaatatgttctcattttatctaaaaatgagacacacctggcacatttgtctgtctccttctgtaggctataagctctttcaaaacaaggacctatcatgtcagaaagacttaataattatttacaaacgaaagaataagggtatccttgaatcaagcctttaatttgaataactcgattggttttacagtagcaccaagttctacttcctcatttacacattgtgaattacaatgctattattatttggaagtaatggcttttaaatgagcctggagttgaaatcgtaggaagaaagtagttctgtgtatgtaaattatttggttgatgaagggggcctgccgctccacacctgtgggtatttcttgcaaggtggagacgagagactgaggggagtctgatctctctttcccccacaggttgaaagagatggttgcatgctgttgttctttaccaataatgccagggataactagccacggagggtcaaagggtagtaaggctttgtaacaactttcttaatgcaatgcaatcatacaggtggtatgcatggccaccaaggagatgcagattggatttaactagaataacctggggactaaccaaggttccttttctcaactaaaaaaaaaaataggtatagtgatgctaaatctctaaatactcttagaaagattaagaaaataattataagatatatgtcctcatgatggaattaaaaatgaatgtattaatgtcttgtattggtagatttgttttatgacccagcatgtaggctttcctgataaatgcttcacgtacacataaaatgagtatgtaatctgcagtaattggatgatgtaaataactctctatatggtcaagctgatggatagtgtttcttgagttttctgtatcttcactaatggtccatcacttgttctgtaaattactgagagaagaatgttaaaatgtccaaatatctttgtgaaggtatatctttctccctttctgtcactttttgcttcatggatactgaaggtatgttattaggtgcataaacatttaggattgcgaatcattatgattttaccctttttatgtctaataagacttcttgtcttgaagcctattttgatatttatacaaccatgtgcaccttcttgtggttagtgtttgcaatgatgtgtatttttccatgaatttactttcaattttttaattgctgtgcatctttatatttaaattatatatgtgcagaatcctatggctgggtcctgttgtagatatatatacatatatatatatacgtatatatatgtatatatacatacatacatatgtatatatatatacatatatatataatcaaataatctctgccttttggaaaaatatattttggtcgtttacatttaatgtaagtattgatatgactgtggttcagtctcccatcttgctggcttttttaatatttggcatctctgatcttcgttactttgtcccttatctcttcctcatttcctgtgttcttttgtgtgaagcagtattttttttaaaatttcttctatctcctccactgcattttaagctacatctctttgtatttttaaattcattcctagagtgaacatatgcatccttaaagtgtcacaatctactttgagcaccaatactaaatgttagggattcaaacacgagcaaggcatatccctccttttcggatgagtggagaaggcagacatgtaagtaataaatacagcaaaacctctcactattcagaggacctttaacatggccacaaggctcaagcttatcattcgacgaacttgctaccagtatttcttggttgtacagattattttttcctcttcgctcactggatttcatatttgtctgaaaacatttcgccctgtttttaactaaattgtgttgtcatttgtatagtctatatacaagtgctttgttggatatgtattttgaaaagattttctcccaatctatatcttgtcttttcatcctcttcacagggtcttccacagagcaaaagtttctaattttcgtgaggtataacttattgattttttttggtttatagattgtgcttttcatgttgcatgcaggaaaactttgtgaaacctaaggactctaagattttcttctatagttttatagtttcaggtttcgattttcactatatgattcactttgagtcaatttttgtatgtggtttatggtaaaggtcaagatttttttttttttggcatttgactatacctaatttatcctttccccattgaattgtcctagcattttgtcaaaagtcattgctcatatatgtcatctatttctagactactgttcccttgaaatattggtctatttttatgccaatactacactgttttgcttactttacaataagtcctgaaatcagtagtataaattccttaactttgacgtctgttttcaaaattattttggcaattccagacctttttcatttccatataaattttataatcaatttgtcaggttctacgaaaaagcctgctgagatttcaattgagattgcaatgaatctatagatcttttgggggagcactgacatactaatcatatcacctcttctgaacatatgcattcattatgatctagcaatctctttctaagtatgtcttagaaactcttggacaagtgaacaaggaaatatacacaaggatgcttctagtactgctgcttgtaacagaaagacaccagaacattttccttatcacttgagaagatagaaaaatggtggcatatttatacagaaaaaaattttggaatttcatgtggcagttaacaatgaattgactcataaacataacagttacattttaaaaaaggaatatatatagtattatcctatcaatattacattaagaaatatgtaaaaccaatcacatgttgtttgagaaagcaaatatatgtgttaagactatacagaagaattaggaaattataaatacaaagttcataataaaattcataatgagctttttacaggatggggaaagcaataaccttgggagggccacaaagttgtatttcttaatcttgatggtgagtacacagaatgttatcaaagtgttattctatacagcatatatgtattttagtatatccttttctatttaatatttaatatctaaatcatttttaaaaggaaagacagagaattttatcgagggggaggaatcagagtaaacttaaatcttacactagtgaaacagggcacaagcatttatggttcaattgtgtaatcgattcttcatttatactattccatttgcagcttatgaactgcaaaacagcatcctgaataaatactaggagtcgccaatgtaaacctgttaatattgtgggatttttttttttttggacactcaccttctgcaaagtaacaaaagcactttaaaatgtgagaataaatgttgttgattgcagaagaataccagggaaaatagcacaggccatgcctttctctcttactcctcctattgggtctgcaggcctttcgcttgcatgagtcatccatactcaggtaagcactgtgcctttattctttattgcactaggcctcttgacaaatgactgtttaaggagtgtttgcacacctgtcaatggttcctgtcatttgtcaagtaacaaatataaaatctgataactaaacaggagaaaacctgtataaaccaagaaatattggtaccataagaagttcaacagatgataaggctaagccctgtggctctctggaagcccctccgaatagtgagtggttctgctgtatttgttatttatgtgtttgtctcctctgctcatttaaaaagtagggactatgccttgctcatctttaaatccctaacacttagcattggtgctcagtaagtgtccttaattgatggaaactgatatctgttgatcccaaataaaaacaggtcaaagccatctttcacggcatattttcaaaccttctgttttcgcattaaatcgtgaaccttttgaaagtatctacacacttttaaaatattttggaggcattattcaaataactattttgatactgagaaaatactaccagtggcatagatacaaattaactcctggatgcttttaactaatttttgtgtttggtgctaatgaaaaagtacctgaagcctttaactttgaagcccgggcttcaaagacatgattgctcagatgtcttgctttattgttgcagtttagcaagacaagaaactctcccaaaatgtcttactattatgtactcactgtagagaaaatatgattgtgaggaagaaaagtaaagaaggaaagcagtgtgagagttaagcacttgaagtttgcctggagtgaagaaggtcctaccagttaagtgctttggattttttcttttttcttttctttctttcttttcttttttttttccagatggagtcctgctcgattgcccaggctggagtgcaatggcgcgagcttggctcactgcaacctccttctcccaggttcaagcaattctcctgcctcaacctcccgagcagctgggattacaagcgcttgccaccacgcccagctaatttttgtacttttagtagagacggggtttcatcaccttcaccaggctggtcttgaactcctgacctcaggtgatctgcccacctcagcctcccaaattgctgagattacaggtgtgagccaccacgcctggctgggattttttcaagaatgtgtactcaaggtccaaacttttagatcatttgaaggaaatccttttgccactctcaggtaaatcactttggagctctgtaaagagtaaaacagccctccgcagccacacacagatttgcatggtggggctgcggagcctcggagtccaagcgtgacttatagtccctcataagcagaggccaagaagaggccagcttttggctttttctttctttctttttcttttttttttttgagacagagtctcactctgtcacccaggctggagtgcaatggtgtgacctcggctcactgcaacctccacctcccaggttcaagcaattctcctgcctcagcctcccaagtagctgggattacaggcgcccaccaccactcctggctaatgtttgtatttttagtagagatggggtttcgccatgttgaccaggctggtcttgaactcttgacctcaggtgatctacctgccttggcctcccaaagtgttgggattacaggcgtgagccacagcgccggaccttgactttctttcttgataactgtaaaagcaactgaaacagatgatgaaagaagaactcactaccatgagccagagcccatagttctcaataactcaccttgcccctgagctgacaccctcccacaccctgcaacaaatacatgtggttttctttctttgagaaacatcactatatttgggcaacatgtcacacacagcccagtgtattctcggtttcccaagtaacctgtagagaaattctatgatgtgatgccctttttcctggaggaccatagaattcagagggagaggaggccttgagaccatcctcaggtctcctgcctgaatgttgctaagcctcaggactccctccacccacatgcaaccacacatagcttttacaaataaattaagagtaagtcttttgcgggtaggtattatggcattttcacctcctctaggcagaagtagtgtggtgcatttttaaggaaggggaggttgctttgcacaggcctggaggcagaagatctagtcatccatatctccccaaagcacactgccccccttatcctcggacttgcttctaagatttgctgtcttgctgagaagttagcagtactcatcctctgaagatgctagactttccagatatttggggaaagccaatgtaatacatagcaccctaggtcagaagtgtgccttgagacagagttctacagtgattacatattttcttcctagtctgagcagccacatatcaactatcaagaaggtttctaccctattcttgatgctatgcctatgcagtttaactccagaatttatgaagacacataatactgttgacagattggatgagaaccattatcatttccccagattatcgacatgtagcatgctattagtaggagacaagcagtagattatgatgtcagtctgtttatgtgtcttctcactaagagaggtgagaaataaaagccagtggggatagaagactggttttggtctggcttaaacctccatactgtggggttttattctacgtagtttgctgtaaacgtgtgcccacttcttccttcttgagggctcccaggtggccatagatctctgtgacatgaagcttctttggagtattctgatgataaaagggagaatttcaattccatttgacaggaagagtcactccctccttgaagtggaaatgaaaatggatccctaactgtgcaagaggcaacgatgaaatagctctccctctgaccctccattaaatgacagcaggcagtagaattattatttggtactttatgcccaccgttgtgtcagctgtacacatgggccaaccacacatttctctccttccataattctgactcatgctgcatgggcttgagaacaatgttgaaaagttcccccagggtttctgatttacagtcccctcccttttccctggtattcaactaatgatttagaagctggaagtagaggaggctcttcttatttctgtcaaagagacagaaaaagagcagtcagagacagactaagaaatcatgattctaggaatggaatgtcccattctagaaggacagtgttcaatgtggtgaagaaattgaggaggagagcagtaggcagaggttattggttttgatggtgatagattctgttaagaaattagtggtaaaatcctggctaacacgatgaaacaccatctccactaaaaatacaaaaaattagttggatgtagtggtgggcgcctgtagtcccagctactgggaagactgaggcaggagaatggcacaaacccgggaggtggggcttgcagtgagccaagatggcgccactgcacccagcctgggcaacagagcaagactccatctcaaaaaaaaaaaaaaaaaagaaagaaagaaattagtggtgaagccatgctgtaaaggggttagaagaatatgggagtagtttgaagatgtggcaaggtcatgtttgtgaacaatggaattcacagagaagaaattttcttgagctgtgatttagtcagattgggatgctagaataccacagactgggtggcttaaacaacaaaatttatttttcacggttctggaggctggaaagtccaaggtcaaggtgccatcatggctcttcctggtttgcaaatggcgtcttcttgtggtgccctcacatgctggacagacaaagagctctggttccttcatcttctaaggatactaatcccatgacctcatccaaactcaattaccttccaaaggtcttacctccaaataacatcacctcggggataacggtttcaacatataaattttggaggagacacaaacattcagtccatagaaagattttttttgaggtttcaattgtataattcttatgaataagttacaagatgtcaactatttattctcagaataatgtttaactgagtaaattgcaaatctataatgatatagtaaaaaccacattgtctgggattttaccacctggaaagtgctagatatcaacacttctgacatttcccaagaaatatttaatttattcctgaggctgatgccaaaagtcaccaactctatgctgaaacacccactacatagcatcacagaatttcagaactgggcaagtatcccatccaaccaactatccttctacagatggagaaacataggcctcatggagaatagaagatgactgttgaagtcctttctaaccctgaagatatataatctcagaaactagcttgctaaagttcatactattcttttaaataagtgaacaccattctctgatcctgattatgtcattactagtgggcaactattgttttttaattcatctgagtgataaatgtgaaatagtacaagcagactatcgccagttctgaatcagctgagtcctaatttatgaggtataaataaatgtattttgagcttctcctgggaatgagagcctatctataatgtttcaatcctgaaaccaggttttatagaagagagactggcattaatcatcacctaaaatccttccaactcatcattgacaggtgtagttagtgatacccatggcttttacacaatgttgtttaaccaggaccaaatagaattctaggaactgattgtccatgacaggaaatcctacctaaacaaaaggcattctaagctcacacagaaaaatgagcaggcctgaacttgagggaacacaagaatgacaacaattgctacatttaaaccaagtgaggggggtaaagagaaactgctgtcagcatttagggagcccaccatcctggttgaagcagacagggcttgattcctgagagatctgcaatgtgcttccttctttagataaatgtggagagaattctgcattcatatgcaactggaattctgaattctgcattcgtattcaactggaattcagagaattctgaattcatattcgactggaaatatggtggttcctaccgcgatgtgcttttctaaaactcccaaatgggtgttcactaagtaaacatgcatttcaaagagaacttaggtaattcccttagcaagagaaaccagaaattctgactggggctccacaatatgtttatgaaaataatctatgtttccggaaattttgggacaccagcggtaaagaaagaaataagactgagaagtccttgaaaatgacaaactaaaaagaagagagatctggaacaataataaaactgcacatagatgagggaaagtttcaagatcttttaagataccagttaactaattgggaatccctgttctgtaattctctagccacacctcccccaataaaacaaattcatttcagcaagactgaaccatcaatttcttatttatgtaagaggatatagaaaattagggtgtcaatattttaaaatttatgcataatttaaaattatacattttttaaaaggctctgggtggttgtaaaaatttaaattccctctcaaaagatctttttggaaattattaaaaagactatgctctgaaaaaaatgtttgtcaacacctggcatgatttcaaagagtgatcctgcacagaaaagtaccaaccagctgatatccacagaaacacttcactgtcaatcattgaggatgaggatccaccataactgtgaggtattcctgttggtcacttatttacaatttcttcaagcaactgtcatactcaggtcaggttgccataacaagaataccatagactgggtggctgacacaacagaaatttatgtctcacagttttgaaggctggaaatccaagatcaaggtgttgccatatctggtgtgtggtgaggggccccttcctagctggccaatgactgcattctcgctgtgtcttcacgtggtggagagcacagggagtgagaacaaggtcttgtgtctcttcttataggggcactaatcccaaccaggagggcttcacactcatgatcaatttacctcccaaagaccctacttcttaatatcatctcattttaacacatgagttttggggaggcacaaatgttcagtccatagcaaggatatttgtcaacttctcccgtaggccaagaccccagttattcttaaactaccactagaaatacacacacacacacacacacacacacacacacacacgtgtgtgtatctatatatacatattgtatatatatgtgtatatatgtgtgtgtgtgtatacactatatatattgtgtatatatacagtgtacatatatacacacacacattgcttttctaagactactgtcttagtccatttgggctgctataacaaagtatctgaaaccggataatttataagcaacaggaacttatttctcatagtcctggatggtgggaagtccgagatcaaggtgccagcagattcagtgtctgttgagggtatgatctctacttcatagatgtcacctctttctgtattctctgacagagtcccccaaacccttttataagaaaattaatgccattcataagggtagggccttcatgatctactcaccacctaaaggccctacttcttaatattatcatattggggatcaagtttcaacataaattttggagggacataaacatttaaaccatagaaatcactgtctcctaacagacacttaggaatactttccaaaaaacttaaaccaacctagattgtgccaaaattaaccagtcaatgaaataaaaatttgaaaaaatttgcaacactgtgcccaaaatgtttttatctaatttaaggggaaacaatacatttccctttggggaattaaattctgtccaaagtgtgagtaaaacatcaagttttaattcagaaggccaatggtaaggagattctttctccaccttctcttttctcacctctcattctcctaccctccttgcaagcacacacaaaggaaaaaaaatgtggtctacattgcctcatagataaggaaccagaggcacagagaactgaaatgcttcactgtatttcatgcagaaagtgtttgctagaattagaattcacttttcactctacaagaccaaacacgacatagactatatagttcctttattgtcattgaagatttaaaatctataacacaatgcaggtagaatgatgtaaattatgtaaagatactcatatagtataaaggtattataatatagtatgtagacactatgaattccaacctcctaaaaacttagctctcctgaaaacctcagagtaaagaaaagtctattgactatgtaatgagactatctctgataattcttatatatagtattctggattggcaagaagtttatttctttttttatttcatcacattcatttagatttatggaagctggaaagatttcccttctcttatggaaatggaattaattgcagcacttcaataatctcagtgaaacccatttcccctggggaaatgaggaaagagacctagacttaatgtagataaaacaaattgacatgggacgtgaatgggagagaaatgagaaaaccattctagactaaaggtcttacacatttcaggaacgagaagtaatagagggatttttattggcagaacttattgaatctcataatttataatgtttaaagctactggtgaccttttcaaaagcaattaattcggttacatatttattgggagctacatcaagctttcaggagtcatgcacgcataccaaggtctttaaaggaacagaattaagtagataaaaggaggaaatcataaaatgtaacatcctttcccaggtggccacagcttgttcttattctatgcttctattagtaaagaccaaggtcacacaagtcagaccacttagagtcctaacaaggaacagacacccttgcaggttctaattgaactgatttgggctagaaactctgtgaacatcactgaagcctgaattttaacaagcaaaaattcaggagggaaaaactattcagatggtcttctacgggaggcaaaatacaaggaaacttttctacgccaacgaactttgcctagcaacgtgataattcacagagtattatcctgcaggcttcaaagacaacagacaatcagcctaaaagttacacctttgcttttaaatttcttcatataactaggaatactggtgtaacaatgtcaattacagcagggggccatacttcacaagcaggaaaattgtagagagatacaggtatgcgccccagttcctgcccctccctttcccacaatggaaagaccacctttcacttcttcgctcactccccatacttccagttaatagcatcaatttcaaatactactacaactttctcatgttccaaaaaattgacaagcacatgaacatccgttcaattttctctggcaaatatttatcaagcagcaaataatgtggcactatactagccgtggtattgattaggcattatcctatcttcaagaagttcactagttaatggacctttgggtgtggcatataaaggtatgataagtataagggccaaaaagacaccacaaagaacaaaattaggaacaaattatgtattactggccaggcgcagtggctcacacctgtaatcccagcactttgggaggctgaggcgggtggatcacctgagatcggtagttcgagaccagcctgaccaacatggagaaaccctctactaaaaatacaaaattagtcaagcgtggtggtgcatgcctgtaatctcagctactcgggaggctaaggcaggagaatcactagaacctgggagatggagattgcggtgagctgagattgcgccatcgcactccagcctggacaacaagagcgaaactccgtctcaaaaaaaaaaaaaaaaaatatatatatatatatataattaaaataccaatctaacagcaacaacaatatgttttgatgctcaagaacatgtccaggacaaagcctgcaggacacaaggtccctgtgccacctgcatctgtcactgcatcattggttctcatgacatgttccagcctcaactgatgccactatacttaattggcacagtttaaaattataaaatattagtagtaaaagggaccttagtgaccatctaggcttatttcttcatttcagaatctagcctagagattaaaatgttggtttttatccccataattaatttgttgaatcgtcaagaccagaatgaatgaaagtcatttaccttccagtcctatattctttagctacaccacactgtctgccatccatatggaatttgtcctatacccacccaaattcttactgcttcgtctcagaaagtcttgccttcaccatggaactcttctaaccactgtctctattgatctcactcttctttgagctcctacaacactcacaggctaagccacaattgtcctatcaattactttattgcttctcgtagggaactctcccaagtacacagtaggtcacttgaagatagagactgatcctcaatagtattcttgtgatcctagcttctgtcgggcacagtcaaggcagccctaaatacctgctcagtggctgaatcatcatttaatgtaacctcacctccatttactatattgggtatatcaaatacttgctattacatgaaaaagccatacctgtcttcaaactggcacacctgctttacacagggcagccaatttgtgctttaaaattctaaataaatttagctcaggtgaagataaggaaaaagagtaaggtgtgattcagttgctttttttcacatatttgtttctcagtttttgtgtgtagaccttggataaggcatttaccttcactgaatcttgaactcacctttactataagggtaatattatctactttacaagtacacatgcttattgtgaagattaaagaaaattgtgaatggcaagagcatatcacactaatgcccatgttttccatcctactgctctagcctctaaaacccaaatccatcctttgtctcattctgctaaatcctgggaaggtgctagcagatatctaaggagttggttaaaacagacttaaggtgagactcctccctaagacagttttttcatggacacaggaagaggaacatcacactctggggactgttgtggggtggggggagggggaagggatagcattgggagatatacctaatgctagatgacgagttagtgggtgcagcacaccagcatggcacatgtatacgtatgtaactaacctgcacaatgtgcacatgtaccctaaaacttaaagtataataattaaaaaaaaattaaaacaaaacaaaacaaacaaaaaaaaacaaacaaaaggcagtgtttttaacaaaaggcttcttcgaacctcaaaggattgctgttctcacagattaggacaggcactggggaagagggccctgctggtgcctcaagtcatccccagaagcagtagcctcggagtgtcttggtaagtggatgcggctgggaacagaagtgcatgcagctgggactagaagccctgtgctctagtttcagctcttgctacattttaagttgctcttcttaaaaatgagggcaatgacactttgggaggccgaggcaggtagatcacaaggtcaggagactgagaccatcctggccaacatgggagaaacccagtctctactaaaaaataaaaaaaaaagaaaattagcccggtgtggtggcacgtgcctgtagtctcagctactcgggaggctgaggcaggggaatcacttgaactcgggaggtggaggttgcagtgagccgagatcgtgccattgcactccagcctgggcgacagggtgagactctgtctcaaaaaaaaaaaaaaaaaaaaatgagggcaatgatttagatagtcaccccaatcattccagccctactatcatattctaccccttcataccaagaagacagatgctaaataaggatcaggagccataatgttaattttaaccaaaaaacccatatatattcatctggtgatactagagctgaagaaaaccatgatgattagtaaagcaagaaataaaaaatgtatttccccggattttttatggttggttgtagatagaaaaatgggggaaatttgctgattgagattaaaataataataaatatgtattacatatatactttgtgagtggcccaggaaaaacagattttttgtttgttcattttttaagaacaggtagaaaaaaggatttttttaagtgaaatgaaatttttatcaacaggaagacacaactcatatgtatgtcctcaaagtctcaatttcagaccctcacatgaaaggctgggactgttccaccctaccccattccccattcccccttgcaaggtcttggcgattcacagtgtgccaggcaaggaagagaagaaggcctctctgtatgggtcccaaatactgcagaggctacagaagagatccatgtctctacagctaatacgccattgttgcagttcttaaaataggtagggtcccatttcagctggtggggaccaaggcattctgtgacatttggatgagaattgcaaagtatctcactgtcaatcaagtaaaggaatatttcatcttcatagcatcatatccaaggcagcaacagctttcaagaaaaaagatgccagaagttcatgggcactatcaacaatctcaataagcctcatgagaaagttgtttcacctgtccttaatgcacagttatgtgggaagagagatttgtttgtgagctttgaagcaaaatggaaaattagcttaacctctgcatcaatagttcagaattgtggccacatctcacattgttactattgttcgtagcaacataattataaaatcgcagagtttaaaattttgtgaagactccctaagtgtttatttcccaatttctaaacagagatactgcacttcttcaaaagagtcatggttacgggtagtctctgcttttggtgtttctacctgcatttcactaagaaaatatcacaatacctcatctatttaaaatattatcagccaggcgtggtgattcatgcctgtaattccagcactttgggaggccgaggcgggtggatcacgaggtcaggagttcgagagcagcctggccaacatggtgaaacgccgtctctactaaaaatacaaaaattagccaggcatggtggcggacacctgtaatcccagctactctggaggctagggcaagagaatcccttcaaaccagaaggctgaggttgcagtgagccgagatcacaccactgcactccagcctgggcgaaagagcaaaactctgtctcaaaacaaaacaaacaaacaaaaacaaaaattagccgggcatggtggcatgtacctgtaatcccagctactcaggaggctgaggcaggagaattgcttgaaaccggaaggtagaggttgcagtgacccgagatctcgccactgcaccccagcctgggtgacagagccagactccatctcaaaagaaaaatatatatatatataaaataaaatattatcaatagcttataatgggcacacttcctacaactccatcaatctgctttcagccaacagccctgtctctggggaacatgtagtgcccggttaggaacttatattttgaactgcagtcgctccaaagggtacaactatagcatggtggataaaaccaacagggctcgtctctggagcttctctggcttattttggcaacaggtggacctgtgtggaaaccagtacttattgcattcattattcagcaggcatttatttacagggtgcctggcatatgcaaagtactaaggttatagcagataataaatgataaatgtatgaggtgacagacatgctaagtaccctgacttgatcattatacacaatttatatgcatgaaaacatcaaattggatcccataaatatgtacaattacaatgtgtcaactttaaaaataatcaaatttttaaaaaagagtccaaaatgccggcctcatgaaccttacatttaccaaattgttgcatatcctgacattgcaaactctggggaccagaaagagggaaccaggcctgggtgctcttatatccctggaaacacagcaggaactactcagaagtcacagaacttcatgccagtgattattcaaataaatggcgcctctgtggttttaaatagaaggtagggaaatcactgtcatttccaaattataagaaataattgataatccagaagttgttcatgttgcttaatagtaaccaccgtgcaccaccctgacttactagagctcttaaaacctcatccagtatatagcactattcactgagcaattaatattctaacttatgtttgagtattttttaaatttccaaataatttgaacaaatttctcacaagaacatatctccttttaaaaatatgacattaggccaggcgcagtgactcatgcctgtaattccagcactttgggaggccaaggtgggcagataatttgaggtcaggagttcaagaccagcctggccaacatggtgaaagcccatctctactaaagatacaaaaattagctggctgtggtggcgtgcacctgcaatcccagctacttggaggctgaaacaggaggatcacttgaacctgggaggcggaggttgcagtgagctgagacagtgcctctgcactccagcctgggcaacagagtgagaccctgtctcaaagaaaaaaaaaagacattaattctatgtattgataaaaaaccctgaacgtcatgttttcaagaacactctttctgctcataactagctatgtgactgggctcagggcattcaataacctcagcttcctcagctatgaaatgaatgtattcaggtgaataattatgaagtctccagtaagctacatgatcttttaatgctaaatagatcagtgcagttggtgtggattgactctgccccatgatgcagtaagagatagaaggctaaatgcagtggttggagcagaaaaggaagagacagacataaacacaccaacaggtcaggagatagagggaggacctgtggtatgaaggcctaaaatgaagcctcaatatgatatgtgccttgacatcttggaaaaaacaggagatcctccagcggcctaactgcaagtttccccctccatggggctcccatagatcctggagccaaacaaccctccttattaagaagtgcaggcccagtttctgcttttctctgagtggcggccttcagttcccttccagcccatggagttattcaaataagccagtcacattctcccatggaaccagggttcaacctcttgttactacaaagcctacctcccacatcccctgattgttcaccgtgttcccaagtgcagcctttgtgtggctgttcctgcagtggcctcctcctgtaggctgtgaatgtatgtgattaataaactgctgtcaatgttatctgtccagcggcaggtgccatttactcggccatctccataatccctccctccttcaaccaatgggatgcagagaaggcaatcaaaacaaacttgttcatgggtcaacttgacacacgcagttgattctgagtatatagaaaataataaggtaaatggcctccaagtgagtgcaaggcaacagagagaccaagaagatacagaggaaggtttttctgtaggcaggtggaggacagccacaggaggtgtaggtagccagaggcagtcttatgagatccacatctaaccacaggatgcagcctccaggcaagacggctggggctggggacagggctccaaagtttacataggtcagacaagcaaactaaaggaaggagttggaccaattatccagacaaagactgagccacagagggcagatacaaatgagtcaatagatgctcaatctaaggaaaaaaacagaactttgattactcagattgaatcatgggataaaatattagcagccaagtcaccctgatctcaagttactgcccttttcctcgtccttttttttttttttttttttttttttagacagagttttgctcttgttgcccaggctggaatgcaacggcgcaatctcggctcaacgcaacctccgcctcccgggttcaagcaattctcctgcctcagcctcccgagtagctgggattacaggcatataccaccatgcccagctaattttgtatttttagtagagatggggtttctccatgttggtcaggctggtctcgaactcccgacctcaggtgatccacctacctcggcctcccaaagtgctgggattacaggcataagccaccgcgcctggcctccctgctttttagcattcaagacagacttgtttccagaggctgaatagagctgatctgtccaggaagttttagaagagctcaaggggaattgtgagtcacaaaaaaatcagaacgagggccacttgccattttcatctcattttaatcatgttatttttccaaggattaacaccaaattttcaagactgttattcacctatttttaaaactattttgcagcttctatgtgtagctctggcatcatgccaggtttttgtgattttcaaaataattgggtgcctcattaaatctgttagctaacccccctaagatcatggagttcggtattgccaagatcacacacttattccattctttaatttttgaaagtggcttttatcaggattatcttggttccataattggctaaatctctccattctatttcctttaatttaaaatctctatccagttcttagtctctatagaacacattcactgcttgagcttttccatttggggccaggcctattccacttgtattacctttcctcaatgtattttataaagatttctgggaggtcttccgtagtcttccacactttgtaggactaagatccatatttgaaatattcattcattcaactaacatttacttgtggcacacctaaaacttgctaagcattggatagaaacttcaggaacctagtgaagaatgcagttttattttacagagtgtaaattttccttttggatacaaaaatgtgacaaaaaaatcaaggcaaattctttttcttcctttccctaaaacctcctcggattctggatctaggattgtacttacaagaccaatcctataattcagacatttggcctctgtatgtaccgtgattaagcaagtaaagtctgggtctgcccgagttaaaaccagtgctttactagtcctacaaatccggaaatcattcagattcatttttctttcctggagacctctgccttctaaccacaggtggtctgtacctgtcctcagatgtgccgtgagattgggtgtcttacttcaggatcctagctccgtctctctcagtttctcccacttcccagcgtcttcctcaaaaaaggatgcatacaaggtagatttaggtgctcctggctgcctgagatgtctttgttccttcctcaccttgcatggaggggtctgagtaagtgtagaatcctactttagatgactgcacctgattactcctttgctcttcaggactccgaagggactactccgttgccttctagggtaccaggatgctgcagagaagctggagcccattcctatttccagtgctttgtttggacttattttttctcttcgatgttctaaaaattcacaataatttgcctttttttctctctctttcaatttttggggctggctacttggcagacctttccctctggaagtgcatattctttggtttgaggaattattcttgcattgtttccactgatttctcccccttattatctctctctatacgtagaacttccagtgatcacatgctagagccccccattttcacatcttttctctactctcatcaatttctttgccttttattttactctccaggcaatttcaactttattgttaaattcttctatgtatttttttagcacacatatttttaatttcacatagcactatcctgtcctctgatttctctctttagcatagaatcaatggaatcttccgttatctctccaaggatattaactacgaggtttttgaagcattctttttttctatactttttaatttccctgtttacacttctgaaaatttaacttcagttggtttattttagaatatgcctttccttttagaggttgttctaaaatgtctgattctagaatgtttctaaaacatttgtatttcttgtcattcgtgtttaaaacaaagccattaaaaagctgaccggaccgttgagcacactaggggtcttgctagctggtggaccttaaggttggatgactgggcagtgagagcttttttattgggacacacccaaagtcactgtctagaggacttttctgctttctggtggaaaagaactgcccaagcccacctgccattcagcattctgggagcagagccaggaagagagctgaggcttccataattcagtgcgtagacttcagcttcctctcctgcattcagccctgtctgtctcttcaccctagaacagggtttctcaacctcggcactattggcatcctgggctctagccctgtgggagactgttcggtgcatcgtaggacgtttagcagatctctggcctctacccactacacgccaggagcaccccccaagttgtgccaatgaaaaatgtctctagatatgggccaatgttccctggggtgggctactgccctgcagggtgcttgggctccctgaggtctgagttcttccaactgtttctccagttacaaagttctaaactcttctagaagcaaagggtaggtgtggtttcctgaagctaggagatacgagagggaaagtggggatgtaaatgccacatgtgaagattttcttgcaattttgcctcgtgttatccttgctctctgtggtatctagagcccccagtcatgtgtcattatgggactctaacagttgctgctcaatgatacctgcagacactgagttcagctttgtccctccgctggatcagtctccactcctccaacccctacatattccaaaaatgtgtggacacctctagcccactcctgactcctcacctcttcactattgaccttgtcttttctgtcttttactggcatttacatggacttgtggaagggggcagagagaagccacatgcccaatgccccatgtttaactagaaacctgtactgttactttacaaatgtgattcctcatttattggtttagtacgtgcataatgaatttcttcagtagttattctagagattctgattaattatacagagtgatattgatcacttatatcattttttcttttcccaactcagatcaactatctcatgctcccagattagttttaacagtttaagaagtatggaagagttgacagactcgtgggtctctttttaaaaaaatctcttttgtaaccagcctagacgccttggctgaacacgataggagggctgtggaggtggcataagctctagtccaaggctcccttttgtggaaacgtgggtagacgcctcctggcggatgcctacagcaatacctggagcatgccagcaagtaaaaataaacctggaagagcactgggttcaagcccacgttccgtccatcccagagggccctcgagcaaggcctcctgcccaatcacatgtttttatcataatagattcttccaggtggtaagagcagtaatacaatcatcacacagtttgccaaagcattttccaagaataactgccagaagtgtgcattcagcttgtgtgtccatatgctcctggtaagatttagaaagcagggaaaagggatgagaaaagattaagtcaggaaaattgaaaaagaaggagacaaattgaaaagggaagaaatcgaaaaagaaagaaaggtgattccactgatgagtgggcgatctgctactctttgaaccataaatacatttcctctaactaaatgcatcataggtattctcaattcgatgtattggttttccacaacctaatctatgaattttcaagtgtaattgtacactgctgtctgaacaacacaagagcaagtccttcagcattgtacatagtgtagccatttaggactgtgcactcaaaattggttggcaaacatagggcattatgaggctgaaataactgtagctcactcttcctgaacctcattacttttggcagtgcctctactggtaagtgaaatgagttggatagcacaggagcagatatatgtttttaagaataaactcagggaccttgagtatcacaaaatcttagttaatccacctcttttcctttagaactctgcttcagcctcacccctctgaaagacctggtgccagctctgcccgcctccactggctccatttatcaatgctggcccctgcatccctgatcctctcactaatcctaagcttagagtggcttttcctctcccatggggccaattcctattgaacttcagttagtccaggtggagtggggctctcggtctaggatacaagcaagctcatgcccttggtctgactaacactatattttaaaattggacccaagaaccaatagaaatacattccttccatttaccttgggatgcagaaatactctcttttaatgatcttgaggtcattttgttccttgcattgcaaatcctacaaggataaaacttttatcttaaatctacttacttaaacttctttttttaacaagacaaaatttaagccatattcccatggctgacacaaaaactgaagcggttttctccatcctgatgtccttggaaattgtacttgtaattcagagatcaagtatctgtcttcgtttaaagaaaataagcaccaactggagctctagtaagttttcttttctctctccaggggaggttgttgccctatgtcatgagaaacacagaggacctgacatgtagaatgactatgaagcagtgttcatagaaataaacccccccccctttttttttttcttgagacggagtctcgctctgtcgcccaggctggagtccagttggcgccatcttggttcactgcaagttccgcctcccgggttcacaccattctcctgcctcagcctccccagtagctggggctacaggagcccaccaccacgcccgctaattttttgtatttttagtagagatggggtttcaccgtgttagccaggatggtctcaatctcctgacctcgtgatccgcccgtctcagcctcccaaagtgctgggattccaggtcccatcccttttaatttctgcacgggccctactttaagtatcgctgcagtggcgaaagcattcatcattgccgacctgtgtggaatgtgaacctgagtattttctattggcgggaacttacgtggctaaaacgtctcctttataatgtggagctaaacagttcaaaatcttgaacagatcttatcacccttaaagtattatgtaatatgatcctcacccaagaatgacctccaagtttcctgacatacttgacgggggagactggtgtcacatgaggaccagtaaaaaatctgtactgaactgaaatttttatgcctcaacatttttttacaaaaggaaatcaaatgtgaaaatttatctggatgctccatacttcaaacaattcccattaaatgcattaaggctttccagtggcctcccatagcaggattcctccaacacttctgtgacggttcattttacatgtcaacttgactgtttcacaggagtgcccaggtatctggttaaacattatttttgggtgtgtctgtgagaggctttctggaagaaattagcatttgaatggtggactgagtaaagcagactgcccatcccactgtgggtgtggcttatccaacctgttgagggcctgaacagaacagaaaggtggaagaagtaaggattctctctctgctggagtgcttgagctaggacattggccttggagtgggatttacaccagcatcatttctggttctcaggactctggaatcagactaattacaccaccaacttccctggcctccagcttgcagatagcagattatgggacttaacctccacaatcacacaagccaaatctttataacgtgtgtgtgtgtgtgtgtgtgtgtgtgtgtgtgtgtgtgtgtgtgtgtagacacactattggttctgtttctctggagaaccctgactactagaatttctttttttttttttttatttttattttttgagatggagtctcactctgtcgcacaggctggagtgcagtggcgcaatctcagctcactgcaacctccgcctcccgggttcacgccattctcctgcctcagccttccaagtagctgggactacaggcacccgccaccacgcctggctaattttttgtatttttagtagagatggggtttcaccgtgttagccagggtggtcttgatctcctgacctcgtgatccacccacctcggcctcccaaagtgctgggattacaggcgtgagccactgtgcccggcctgactactagaatttcttataatggcctacccaaggtcacatatgatctcactcctgcagacctccccaaattatttcctacagcttccccctccccagcttcctgctgtcctcaaacatgccaggattactaccaatttagggcttttacacttgtttcttaagcctagagtgccttcaactatattttgtcatggcttttgatttctgctcaaattatggcatctcatatgtgctttccttgaacagccaatctgaaaagaagttcctagccccatctgtatccaggctccctctagctgtttttccagtggttgaggtctttaagtttaatatctctccaaatatttctttcttctcaactcccattttcctctcttctagactccagttacctgtgattagataatttgatattatccacaggtctcaagtagcctttttcattttttcactcttttcctctctattttgcaaattggataatttctattcacttgttcaaatttactaatcccttcctctgctatgccatgtttgctattaaacccatcaaaaaaattctccatttctgatattgtacttttttttccagcacagctgtttgattctctatcatttctatctctctaagatttcctttactttttcactttttcattgtccatttttctgctgatctttaacatatatacatatgtatgtgtgtgtgtctgtgtgtgtgtaatctgtccaataattccatctggtccattccttggtctgcttctgttgactattttctctcttgactttatgtttcttcacataattcatcaatttttattgtggttcagatattataggtaaagtattattacagactaaagtaaataataatgaacccccccccccaaaggatacactccttcttctctcaaggctgagttagctaatctgcagctgagatgtgtctgaacttagtctagctttagttagattcagttgaccactaactataagtttgaagacatgataggactttctctttagcaagattgggtatctgcacattgtcaagactctgaaaatattgttctccttaacagcccagccaccaaacttctaagctctggaaatctctatctacttgtcagtccatctgttagcttttttttttgagggagatggagttctcagggaattgttttttgttcatttgtttgttttgtttgtttgcttggttttggtctagtaccacttctagctttgtgtgcctccaagtagtgctctctcttagcattactgtctgactgccagcctttagggtctctatggtgtgttctgtgaagaccaatattactttggtggaattattctcagctttcctgcccaactctagccctcataggacttctgcagtgtacttggtgaggcctaaagtgcctcaaagggatttctttcctctctcctgctctacccctagacttcagcagccctctgccttgtccttaaaaaaagtccctcatatctcagggtaaattagttcagcaaagctgctctgattccatcatttggcactgtaccctgtgcatttagtgaaggtccctggaaaagagtgggcagacagatgcagacttttgtgtctggagctccttgagattctaatccttcctgccagctcatatgcagccaccaaaagttgggctggtttctcttctcctattagtccaccaagaataaaagcaactgtggatctcttctctcatggaaatgtcttgccactttctggaaattagttaattgtctctttttgcatactcagctctgatgggtttgagatgttacaatgctgtagagtgtctggcttgatattaaggttagagtggaagtgatagtctcttgtacttcctacatctatccagatagaaaagttcccaccacatctttgtcatctttatattttcagcatttgtactggtactagtacttggtagtcactcaataaattttttgttggatatgtaaaaagagaacagtgatattaactagacacctaattggtagtattaaccagacacctaactggtaaaagattagttaaacctaaatatgcccagaattttttgaagaggcaaagattatacaaataaaagaatttttaaagtaatttatagtaatgctgccactctaacacaactatgtacatggaactaatattatttattacgatcttataacactgatgcctatctgaattgtgcagatgaagaaaaataatataatctatgcagatataattatgacattagctgaggcaggaaaagtaaactctaatgtatttaagtggaaaacacacaaattaagttaaaacaaatttttaatggaagagtagaactggttcactattcacgacttttccaggtttaaaatgaatacaattatattactagtaaaacctcattacggcccatggaaatgccctgtggttacactcagtgtttcctcccaatctcatgattgactatggaaaactgcaaatctaggttttccctggttcatatcagcctgagaaattagactgaattatctgtaacatctcccttttaaacatgtgctttcagataacatcacgaccagagtactgacgagatatttccttatccaggacggactgattattcaaattaactttggtagagtaaacatgattctatattatctgaatagctacttggtttaactgacagaaatgaggaacagggtcagaacagtcagtgtactataagtgcacttatggcatcaaataccacaagcaagccaaggctggttcagcaaagcaattttggagacatccctccccataaagcctgaatatagctggcccctgttcagctctggttgggggaaaagtggattattaagaaaacacttcagatgtggccacagccacatattaatagccacagtccagcaataatgctttgacctgaggctgataaaacatggtggagtacctactaatttagattatgagctaagaaagttgtctattttttcactccgaggaaaggtaatatttagtaggaacagtttgtgcaatgagtcattttcatccataaaaatatacactatagcacacccctaacaggatacttgtttagacgttcttagacttggtcgccttggcttccttttggcatcctatggtaggatcctatgacttgattctttagaatcctctatggtaggaaacgttggtgacccttgaggccgtccttctctctctcatagcaattaagatcaactggtagatctttactagtggactcagatgggaaaacaggagttaagggcaggcaggatatttattcatataagcatgtcaaggaacttctttttctaatgattccacagagccctattttgaacaacagctgggagagaatcaagcaagctcttttaacaaggcaggctgcaagcattgccattccaggagacagtttagatgcaactattcactcatctctaaccatcacttgcgtgaacattactcaaagagatacagcaaccaaagaaatcaaaccagtaaaagaaaggtttatttgtttaatagaggtctggcagctgaggcaaaacctaacaataattctgatgaagactcagtcatttatttggagcttctaatgaatctaactaggtaccttatacaggcttgcgtgggttaaatcacagctgtaaagtgccatgctaacagatgagagagtatgtgattgtatcagagatactagggcatccaattatatttatcacctgcctcctattaaagcttttttctgttcttaacgtttgtgttggtagtggcaacatagaggttacagtgagctttgtcctaaagaacctggaaataactgaagtatgagtcagactttaggagatcagctcagaatggatcagagctcagaggaaccttgggacctcattcgtccaatgtcctaatacagatcaacgatcaaaacagtctatcaagggttcagcctaaacacaattaacatggagcaactcttgccattagtatatttagctctcgataaagcctgagaggttaatatgattctagacaaccattcataggcagagatatatcttcctagccaaaaagaaaaaatatagttcttaaagaagagtaggaaatggcttagaagtgatagttttatttccaattctcaattccctgtctcattttgctaaatgggtttaaggagcaacgatgacaatctgctacgatttgcatactcaagcaacactatgaatcactgcaagcatcctcttttgttgcttcattttagcttagtcaacgtccagacaatcagggtgtattgagcatcttctctgataaaagtattttgaagaaaaacaaaagaatggaatgttccttctctcccaagggacttaaaatgtactacctggcatacaagtatttacatcttaaaatgaaaagcagtgaataaaatcatagaccaaaactaatggtgaatttccagcctccagtaaagaatttttcttgaataaacaagtctattttatttcttttcgttctttttaattttaatagtacaggcgacagttaaaaataaaagagagagagaaaggaagagagaaaaaaatggattgattgattcaggtatccttcgtacctctgcccagagacaatgtccatcgtcagcttttaaaatgcatcctaagatgtgcatacaaaatagcatcctactgttttttacttaaaatatatctttacttaaaatacattccagatcactcctgttagcgttgctacatttttaaaatagctatgtactctcctattgtatgcattgctccaatttcttctatttctgctctacataattctcttgaaagaccaaaggctgggctcatctttttcgtcttgttatgcccaatgaattattttttcaatttttgaagtcaaataagtttaccgcaatatatatctgtattttgatctttatgtaaacattagtttggcactcacaatcaagcatgcaggccaggcgtggtggctcacgcctgtaatcccagcactttgggaggccgaggcgggcggatcacgtggtcaggagatcgagaccatcctggctaacatggtgaaaccctgtctctactaaaaatacaaaaaattagccgggcgtagtgatgggcgcctgtagtcccagctactcaggaggctgtggcaggagaatggtgtgaacccaggaggtggagcttgcagtcagccgagatcacgccactgcactccagcctgggcgataaaacgagactccatctcaaaaaaaaaaaaaaatcaagcatgcactttgaacaagccagggtgtaagcattgccatcccaggggatattttagctgtgacttttcactcgtctctaaccatcacttgtgcgtacattactcaaagagatacagcaacagaagaaatcaaaccagtagaagaaagatgcatttgtttagtagaggtctagtagctgaggcaaaacctaccaataattctgaaagagacttagtcatttatttgaaaccttttatgaatcttctggttctgtaaagttttactgagttgcatctttagtttttctccattttgttatttgattctcttcttcaggaatagcaaatatctgtttgtcgattcactttgtcttccatatttaccattgaaaaactcattttaactctttgctcatgttgtctttgttttgcccgctgttctcagtgccgtcacagcgatgcttcctgccatattttcaataatctttaatttcccttgggttatttccaaacaggactttatatttgatgttcgtatttttttcttctacttattgcctgagcttgatcagctcatgtttaatcttcttccattgcttcaccacatttttcatgacctcttatattcatggcttaagtttttgttttctggaaattattgctttctttaaaaaatgaacataagccagtattttaaacacagatattttgcattgggaagattttttagatgcacgttttctatctgccatttatttttgttttttctaatctattctacattacttccctgcaggacctgttctttgttctcctcaccctaccccaccactcaatttatcacttgtctttgcacgaagtgagttgtttcaggcgcagccattgttgttgttagtgaggttctttgcggtgcagagttgggtgaaggcagctacaggaggctcaagggcagatcctccttcaccacagagctcacaactatggcaatggctgtgtcctttctcattcacccaaacccactgagtatcccttttccaccagcccacacacctcaccactgctcccaacaatgggtggttgttttgcccctcctgttgcgccgctagcattgaagatctacgttctgttggctttgtctacgaactgccacgtggcgcatcctgactcggcatctctgcacacctccttttgacttctttcactgcacttgtccactcctgttcagacactgacatttaggatggcacacaccttctagttccactgaaaataaatcttatgtttcctgtttctaatctccttattttctggagaaaagaatggaagcaggatccctttactccaccataaaaggaacacatacccacaactattcatttggggacttccaaccatatacacaccttccccatagttaagtgccactttaagtggttccttcgccattgaagacaatgtgaaaggcagtgtgaaaggcagcaagatctcataaattcttcataacatatataatatatataatataacatataactttataatgtaacataatataattacatagtaatacactggagaacacggaaaagaattaggaaaaaagattttactcctttcagtatccaagagagctcacagagcatcattcaggactcagaaagaggggcagagctcagttacagtgaagaatgggttccccttgattttcctactgtttctatgttctttgagggaaagtaaagaacaaacgtattttgtgtaaacatgctcagtgttgaaattgtatgacaaaaatagtcttctaacaaagataataataacatctgctgagcacttagctatgtatcatgtacctatgtcctatatattttttgtattaaaactttattgtgacataaccatagattggcatgcagctataagatatgatacagagggagcatttgtactctagccaacctcttccaatgctaacatcttgcaaaagtatagtaaaatatcacaaccaggatgctgaaattggcatagtgaagagaatttttccattactacaaagatcccatttattgccttttttatcaccttactcaccttcctctacttcatcccctacatcagtcctaaaaaccactaatctgctttctgtttctataattttgaaatttcaggaattttacacaaatatagaattatatgatatgtaaacttctgagattagttttttcactcagcccaactttctagagattcacccaggctgctgtgtgtatcaacagtttatccctttttatagctagtggtattctatgggaaggaggtaccacagtgtatttaaccaatcccctgtggaagaacatcttaattctttccagtttggggttttttgtgggttgagttgtgcaccaagaatttacacggtgaagttctgattcccagtttctctgagagatcacctcagaacaagatcttacttggaaatagagttgttgcttgtatcattagttgagataatgtcatactgtagttgggtgggcctctaatccaatgtgactggtgtccatataaaaaggggaaatttggacacaggtgggcacacagggaaaatgtcatatgaaaatgaaggcagagatcatggtgatgcacctacaagccaaggaatgcccgtgattgccggatccctccagaggccagaagaggggaatggaacacattcttcctcatggcctgctgatacctcaatctcaggtttctagtctccaaaactatgaggcaatacatttctgttaattaagccacccagtctgctgtactttgtttaagtagttctagcaaatgaacacagaactactgccagtaaagctgccacacatttgtgtacaagtttttggtctttgttttttgagacagggtcttgctctgtcacgtagactgcagtgcagtggtgcaatcacagctcactgcagcctggacctcccatgctaaagcaatcctcctgcctcagcctcctgagtagctgggactacaggtgtacatcaccatgctcggctatttttgtttgtttgtttgatagagacaggatttcactgtgttgcccaggctggtctggaactcctgggctcaaggaatcttcctgcctcagcttcccaaagtgctgggagggattacaagcataagccactgcacctggcatgtgtgcaagactttttgtggatatatgtcttcagttctctgggctaaatgcctaaaggacaaaatgatagttgcaagtttacttttgtaagaaactgccaaactacagctgactcttgaaacacaaggtttttaactattcaggtccatttatatgcagattttttcaataaatatactacaaagtttgttagagatctgtgacaatttcaaagctcacagatgaaccacatagtctagaaatataaaaaaaaataagaaaaagttaggtatgccataaatgcataaaatatatgtagatactagtctactttaacacttactaccataaaatatacacaagtctattaaaaagttgaaatttatcaaaatttgcccacacaaacacttacagatggtacgtggcaccattttcagtcaaaagaaatgtaaacaaacttaaagatgcagtattaaattataattgcataaaatcaactgtactccatactgtactgctgtgataattttgtagccaccttctgttgctattgtggtgagctcaagtgttgtgagtatccacttaaaacgctctttgtccccacacagccagttcgtctctccagtaaattgcctatcacagcaaaaagtgatagtttctggttcttgggtatttttcatcatgtttagtgcaaaccgtaaacgctgaataacaccatgggacccacatgaaatatcactagtgatgccagaagtgctcccaagaagcagagaaaagtcatgtgagttgcttgatatgtaccatagattgaggcctgcagctgcagttgccaaccatttcaaacagacaattcatcttgtaaacagacaacataaacttaaggcattgatatatacagcatggcactgtaaatgtactttttcttaagattttcttagtaacatttccttttctctagcttactttatcataagaatataatatgtattatatatacaaaatatgctttaatcaactatttatgttatgaattgcattcaacttacatgtcagcttggcaagaattgacatcgttactatgttctcaaccaatccacgaacatggcatgtctctccatatatttagttaaacgttcaactacttatgttatcagtaaaacttctggtctattagtagttaagttttgtgagagtcaatagctgtactcatattttcttttgttttccctcaaggagtacatgtgcaagtctgttacatcgataaattatgtgtgctgaggtttggtgtacaaatgatcctgtcacccgagtagtgagcacagtaccctgtaagtaggttttcagtccttgtctctctcccatcctcctcccctaggagtccccagtgcccagtgtctatcattcccatctttatgcccatgcatacaccatgtttagctcccacttataaaggagaatatgcagtattttcttttctgttcctgtattaatttgcttaggataatggcctccagctgcatccatgttgctaaaaaagacaattgtaagtggtatgtatctttaattttggtgtcctcacattcattactataatatagaaataaaattgatttttggatgtgtatcttgggtttcttctttgggttccgtgaccttgctggactcattcgttagttctaagagtttttatgtatatttcttggaattttctacatagacaatcacgtcatctgcaaataaggatctcttcctttctgatcgaaatgtcctttctttttcttatcttattgcactggctaaaacctcaagcactctgttgaataaaagtggtaaggatagacatagttgccttgttcccaacattaggggaaaagcattcagtctttcaccattaataataatgctagctgtagggtttctgtaaatgtcctttattaagttgaagaagttcacttctattcctagtttcttgagagttttttatcataaatgggtgttaaattttgtcacatgcttcttttgtatagattgatagaatcacgagctttttcctctttagctttctaaacaactcctttgtttcctttaactaatatgtgtataaaatttcattttccatccttcacctcctatctgcttatcattatatttgaagtcggttctttatagaagtaatactgttgctttagtttttacattatatgtacataatttatgacaatctactagtgtcatcattttaccagtttgagtgaagtacagaaatcttacctcccttcatgtccttttatcctgtcctttttataaaaagctgtcttaaatatgtcctttatatatatttagagccacatcagacagtgctgtagtttttgcttcaactgtcaaacatatgtagaaaactcaagaggagaaggaaaggttattgtatttaacaatactttcacttactatagtctttgctcctttttcatgttccaaggttctgtcttctatcacttcctttctgtttagagaatttcattcagccattctcttacagcaggtctgctggcagtatattctattagttttcctccatttgagaatgtcttgattcctccttcattcctgaataatatttttgctggatatagtgttctgagttgtcaattcttttcttttagcacttaaaaaatgtgtcatttccttctggcttccaatgtttctgatgaaaaatctaatttttcccccagtaggtaagatgtcactttttaatgaaaatttttaagattttttctttaatattcataagtttaattatggtttgtttgacatcaatttctttgggtttcttctgtgtgaagttcactcagcttcttgaatctgtaggtttaagtcttttgccaaattcgtgaatttttcagtcattatttctttgagtgtttttctatccaacctctttattttcctccttacaggactctaatgacataaatgttagatctttaattgtagtcccacagatctctaagtcttcctatttaatttcagtctatttcctatttttcagattgggtaacttctattgttctatcttccagttcaccaattctttcctgtgccttcttcattccactgatgagccaatccactgagcttttctttggttattgtattttttagtccttagacttacatttggttcttttttgtaccttatatttctttgataagactttgtatttatttactgaggctttctattttctcatttgtttcaagtgtgtttgcattgcttattgaatcatttttttcatggctcctttaaaatctttgtcagataattttagcatctttgttaccttggtgttggcatctattgatggtcttttctcattctttttgagatctttcttgtcctccatataagtgattttcagttgaaacccagaatttttctggtcatatgttatgaaactttgaaacttatttgaaccttatgtattagttggcttttctaatacttctttggcagggaagagaagaggaaccaccccatgactaccagttggaggtagaagtctagttttgcaacatggcctccaatgccacctaggggtggggggagtgtttggcagggggggttgttctggttccctacctggtgttcaatgataccagagtggtgatgtcctccttaacctggcaataaagtcctgactctccactaagtaacaccccaggaacaatggtgaaagtcctgacttttctctgacaaggagagagaatggggcaccttgctactgtcaggtggagattcaagtccagctatccacatggtctctactgacattgtggtggaaagtgaaggaagtctcaatgccagtgacaggaacaaaagtcccagctccctacttggcctctctgacatcaccctagtgagagtgctggggaaccccattatagcttgtgaaggtagaagtctagcctccccactcagcctttgctgatatgggtgggagtgatgctacagttttttctgtagtgtttggctggagtaaagtggttattatccaaaagtttctgtctttctttgtttttttttgtttgtttgtttttgtttttgagatggagtctccctctgtcgcccaggctggagtgcagtggcacgatctcagctcagtgcaagctccgcctcccgggttcacatcattctcctgcctcagcctcccaagtagctgagactacaggcacccaccacaatgcccagctaattttttatatttttagtagagacggggtttcaccatatttgccaggatggtctcgatctcctgacttcgtgatccacccgcctcagcctcccaaagtgctgggattacaggtgtgagccaccgcgcccggccaagtatctgtctttctatgctgccctttttccagggctttgactagagagaccaggcttttgttggggacttgtcttgtctgtgcccattggcattgctgggttgtgggtttcttctactccaaatatgggatatgagtggaaaaaaacacagggaactcattagcatgttattcctcatgtcctgagtccccagctaatctgccttgttctcttcttctttcatggcctccctacatttgttttatgcaatatatacagttttttattgtaattagaggatctaatagaggacgctattcctactccatcttcttggaaacaagagtctgtcttagatattttacacttactcatttaattctcacaataaccttttaaagtagtattattaaggtctcaattttacatttgaggaaactgagttacagagaagttaagtagcttgtctatggtgacatgctaacagcagcaaagccaggtttcaaacccaagaagtcagcctccagagtcagtgctttcaaacagtatactagaactgttttcaagtaataaatgttcacaacgaagctcctcatttgtcttggttggtctctccctgcagggctggactcccgattattgtacaatagttgagagtgccctctgtggaacatagtcctcaggttacacgccccatcttttccccacttcttacccacaagtatatacctagttttaaaggtgcagggttataagcataaaaatgatcagtcatgatcaatcacatcccttatttttgaaaatccatcatgagtgcgcataataacctcaaaatgagagccatgaatgtaatcatcgtccctgtgtttattaatcacatccttttgaattcaacactttttattttctgccaacttcttgctgcattatctacaaggtaatcattctttcaagggatcttctttaagtctcttccattctctcagcctttagcccaagtcacctccatcactttcaataagacttcaccaattctgtaatgttctactacatcaaaagccacagaagcattgagatggaaagagcctttagggaccattttgctggtgataagagaactaagtgacttggacaatgttacactgcttcttcgtgacaaacctgagactagaaaactactacatatgacatcctacacactgactcccttcttcagctctgtctgataaagggatgagagatcgtttcttattattacacatacacgccacttccgttccttccatctaaacctagttcagaaacaccgctaagaattcccacccccaaaaaaatggggatgggggaagagaaggaagtgaacagtggtgtcatcccaccaacaagcctgactgcacaaactatctgcctgttccataacaaagagattatatcaaacctacctccccaggaatcagtctgattcaacctcggaactcctccttctcctttccatttggcccaaactagggtttttctctcaggtcttttgggctttctgaacaagtgccagcaccctgtggcttgctgctgccagcccaactatagtaattttccagaagtctctggttatgccacactgctcaaggaagaggaatatcattaaagtgacttcacagccccataaacatgccacttgcagccctcttattctgtctggtggcctacaccacacactacaatcaacaagggacatctagatttcagggccaaatccctgcaaagactctgtctgaacatacttttgtgaaagcctgcagaatatagatttctgtgtgtcataaggaaataatcggtccttaaatctcaaagtacaactagctgcagtatttaaaaagcccatggacaatgacaaatatagacatcacaaaattattctaaactgatcaatgctgagaaaagtcatgatgtgtcaggagtctcagctccaaaggcagtctgccctttaacataatgaacttcagtaaaagtagaaaccatttctgagggtgtaattgacaagtggcaatgaggtcatcagtagagtttatgacatttaaatccctgtgatatggtttggctgtgtccccacccaaatctcatcttgaattgtagctcccataattcccatgtgttgtgggagggacccagtgggaggtgattgaatcatggaggcgggtctttcctgtgctgttcttgtgatagtgaataagtctcacgagatctgatggttttataaagcggagttcccctacacaagctctctcttgcctgctgtcacttaagacgtgactttgctcctcctttgtcttctgccatgattatgaggcttccccagccatgtggaactgtgagtcaattaaacctctttcctttataaattacccagcctcaggtatgtctttattagcagtgtgaaaacagactaacacgccctggatctacttttcccggttttatttttttgtaacccacaagctgtcctgcctcgtgtaatggtcttaggcaaaggaagacctctctggttatccttaattctatagatacctacttcacacacacacattcaaacacacacatacacacacacacacacgacagagggacttctaagtaaatatcatatacattatgaggaatcaagatcttgcccttttctaaagcaaataactgtcaggcttgggcaaatgcaggggccatattttctaatgaaaaaataaaaatatatgacactggacaaattattgaaaatggaggtatacattataacttcccttactttagcttgctgacaggtaaccttgggctctgccacaaagtaattttcccatctggactaactggggatcagacagaagattctttttctttcaaggtgtcctagaaaattggggacaccttgtagcaaatcaattaacattttatttgatgtagaaccttacgacaaatagtgagaatttccacaacacaaaaattgtgaagtttttggcaatgcataagaaatgaacattggcagatatgtttcacgtggccaagaacttgatgtttcatcagccatgaggctggtagtgtctctattttacacacgtgaaacatgggctaagtgaggtaaagcaagttgcctgagatcacgtggcttgtgatgagaagattcaggattcgactccagctctgtgctactccagagcttccgttctttctcacatatctagttcaggctccttcatctccgagtgggtatggagaccaagtatgcctgttattgttcctcagagaaggatttctggaggacatgagtagtctgaagagttcagcaagtcctccaagttccacccaaatctgataaatgtgctgaagtacggggcgctgttactatacaacatggtgagtaaagggaaccttctctctgatccccagacaccccagatggaaaaaggtgctttgctgcagagcccacggttatctgtctggaagcaaaagtaagggaggccacaaggtctacttccattttcaaactgagggcgcctaacaattgcaatcctgtaaagaaataaattcatttctggaaagttggaaattgtcttcatcgtgccctgcccaaagcctctggtcaagaaattgaggacttgcagaataggactcctcctcaaactcaagcttttgtgttccatgttcaatgagagattctggccacagaaatgttccctacctgctccagcaggaactaagccttcctggaacatgattatcacaaggatccctcccagtgaccacattttctgacatcagcctaaaccaaaacgactcgcctgctcagtgattatataaatccattcagtctctgcaaatgcccaggcttttgttaccactactgctgttttggctgtacaaggcttaaaatgcaaagtaagtcacgatactaacctttgcctccagtaaggaatgctcttcttggagcagcccccatacctgggacaatgcaagtcagcctttcaatgagatgcttagcacacaagccttctgtgatccagctcctgcctctccatcatgcctcagtgtccaacactctctcttcttcagtcaattcaaactatttgtaggtccctaagcacagtttcccctctttctgccctgcagacctgctttatctagcaaatgcccactcattattcaaatttagtgcaattatccagtcatctgggaaactccccttgatccacaaccttgatttagtggtctcccctttgtgctccctgaatagcatgtccatgcttctccgatagtgctcaccacattttatagtaacagctgatgtatctacttgtgtgccccaaccaaaaatcaggttctacatatcttgaggaagttttctcattcaattttgtatgagaatttacggaacttccaattctataacatagttgttaaataaatgcttaacgaaaaggtacacttggttcactcaccaaacaaatatttacaaaggaactacaaggtatatttagaaagcacatgagttcctgagcactgatcctaagttgaagaaaccctcctcacctcaatctcttgggcacatgagaggtctcctcacagactctcaaacaattggtgcttgaagagaggtgggaagtggtacgagggaagatggagggagagcatgactgcctgctgctacctgagtgagaagaggaaagatggagatgagggcaagcagaagcatgtggtccacagcatcacctagtgcctagtgcggaagaggaaagtcttggttccatcactcattctagcttagagtgaatcttctgttgcaaactttcttattgctctaagacagagatcatcagaattgaggcaaaggctaaagcagtactacactttctatgtcagtatttttatatactggttagtggtatacatgcatgcaaatctccctttaaattcaaatgtcatgttagaaagtagggtttatatgtacaggtgtttgtaaatgagaagtttgtaatttagggagtacatatttaatagtgcctcacccagaactgctataggcaagatgatcaggaggaaaaacagcagcagctgatgccaaaatgtgtgattcagatgatttggaaattaagagacattccaaagaacgtgtgcatatttccttcagacatagtctactagctaacagattgaatttttaaaatatatgaataacttttctgacaaaagcttaccaaaatacagcaatgacttagaaatttagcatggttatatgtgatccgtttatctctcccatcatcccactatctcagagtacaaaataaaaatcattcgtttcatttttctttatgctaagtagaaaggaaattgtgtcctgttctcatttcaagttaggttgcttcttgattaaataagagaatgaactcgcctagaataataaatgatcctctcaactgcacgttaactgaacactctagcataaattaacaaagcagagagatcaggtggaagtatagctaaaagactaaaattagtttggcatgggtttggatattagttttgtcactctgtagctatgtaagtttggacaaattaccataaactctccaaatctcaattttctcaactgtcaacagagttgacagcaaatatctcatgaaatggcgagacagatttcaaacttgtcatttacaaacacctgtaaatacgaactctactttttaatatggcattacaacttacaagatttgtatgtatgtatgcaattaaccatgatacaatggcagcataaaatggcaccggtaaagtgtcaggcacacagcctattgcagagtgaacactcacattttgtttccacgtgccccacctcttttcttgatttaaaggatttctactgggcaaatgataagagaaacaagacacttttctgtccttaaggaacttagactggtaaagaggataaaataaacacagacaaagccaggcaggatatacattttgagagcagaatgaatccaggtgatataagaacacaaaggaggaagaccatgtgccaagttccctgaggacatcaggatcaacttcatgaagagaccattttaaatgggtctcagagaattggtagggaccttgtcaatgtgtggtttttatttcctaagtaagactcacagttacaatacacatgtaaacacaggagaagacagaagttaaggcagatgatactctggtttaaaaatccttagaggaattttcactggtcaccaacttttagagctacattgaggatgacaactagggtggaaaacagtatattgtccagatatactattaatataaaatggggcaatgttgcctactgaagggaaggtaggggcaagccttatctttccctttctggctcagagaattcccagctttttttttttttttttgcttttttgagatggagttttgctcttgttgcccaggctggagtgcagtggcatgatctcggctcactgaaacctctgtgtcccaggttcaagtgattctcctgcctcagcctcccgagtagctgagactacaggtgcctgccaccacgcccggctttttgtattttttgtagagacagggttttgccatgttgggcaggctggtctcgaactcctgacctcaggtgatccacccgcctcagcctcaaagtgctgggattacaggcgtgagccaccatgcccagccagaattcccaacattttaaccaaagcactaggagctttccatctgtagtacaatcaccgaacaagccagaaactgtgtcatggcctctttaatccatactattccttctacagagactaattcccttaaaaactaagagacagatgcagccttagcctcggcctacacagggtccagatcatccatatcactgtttccacctccatgtcttgtcctactggaaggtcttcagaggcggtaatatgcatggagctgtcgtctcctgtgacaacaataccttcttctggaatacctcctgaaggaccttcctgacgctgttttataactaacttattacatacttctacttacataagtaaaaatacactctaaataatgataaaaactatagtatagtaaatacataaaccagtaacatagtcattatcattattaagtattatgtactgtatgtaattgtatgtgctacacttttattcaactagcagcttagtgcaaaataaaaagagaggactcaaaggggatcatttaggaaataaactactcccgggaaagggacacaatctcaacaagcaatagggcggcttgtgtagtgtagtgggctttggagaagatccctggtagcagtggagattgggagttgtggttttcacgtacttagtcatttagtcaaccagagagacaaatagttgggataaaagaggatctcataaatccaacagaagagtacagaacacagagcttaggctgttcacagcaccacctcctaggaaaacactgtgagcactcaggttaacagtaggtagatctgtgcacaagccatttactctactatggccaagcagcctaatctgtcgtgaacattcctcttccccccaaaaataaagaggaaataaagagaagggagaaagggagggaagaaggaaaccatgagtcttaaaaagatagcacagaaacaattattctgaaaatgtagaggaaaagtatagctctttaaaattatttacgacacaaatcagaagagttcaaataaattacaatgcattcatatattttgcagatgttcactcatgttctcaaataccattaaacgcatcagaaaatttgtagaatgtaatatgaagtgaaaagagctgggtgcaaaagctgtatatatcaactttacaaaactttgcacatgcggtacatataaagtcatcaattgcttaacaacatttcagtcaacggtggactgcagatatgacaatggtttcatgagattataatggagctgaaaatttcctatcgcctagcaacactgtagcagtcataaagttgtagcacaatgcattactcattgttgtaaacaaacacactaagctgctagttgaaaaagtgtagcacatacaattacatacagtacataatacttactaatgataatgactatgttactggtttatgtatttactatactatactttttatcattatttagagtgtatttttacttacgtaagtagaagtatataataagttaattataaaacagcttcgggaagttccttcaggaggtattccagaaggcattgttgtcataggagatgacagctccatgcctattactgcctctgaagacctttgtggaggtggaaacagtgatatggatgatcctgaccctgtgtacgctgaggctaaggctgcatttgtgtcttagtttttaataaaaaaagtttttaaagtaaaaaaaattaaagcacaaaaaggcttatagaataagaatataaaaaagaaaatatttttgtaaagaagagtcaaaaagttaagaaatttaaaaatgctcatcatcactggtcattagagaaatgcacatcaaaaccacaatgagacaccgtctcacaccagttagaatggccatcattaaaaagtctggtaacaacagatgctggcaaggctgtggagaaataggaacacgtttacagtgttggtgggagtgtaaattagttcaaccattgtggaagacagtgtggcgattcctcaaggatctagaaccagaaataccatttgacccagcaatcccattgctggatatatacctaaaggatataaatcattctactataaagacacatgcacttgtatgtttattgcagcactatttaccatagcaaacacttggaagcaacccaaatccccatcggtgatagactggataaagaaaatgtggcacatacacaccatggaatactatgcagacataaaaaagaatgagttcatgtcctttgctgggacacggatgaagctggaagccatcattctcagcaaactaccacaggaacagaaaaccaaacaccacatgttctcactcataagtaggagttgaacaatgagaacacatggacacagggaggggaacatcacacactgggacctgtcgggggtggggggcaagaacaaatacctaatgcatgggggcttaaaacctagacgatgggttgacaggtgcagcaaaccaccatggcacatgtatacttatgtaacaaacctgcacattctgcacatgtatcccagaacttaaagtaaaataaaacatacaataaaataattttaaaaaatgtaaaagtcaaaagctacagtaagctaaggttaatttattattgaagaaaaggaaattttaaaaataaatttagtatcgcctaagtgcagggtttataaagtctaccctagggtacagtaatgtcctagaccttcacattcactcactactcactcactgactcacccagagcaactcccaggcctgcaagctccattcatggcaagtgccctatatgggtgtaccatttttttcctcttctataccatatttttactgtaccttttctatgtttggatacacaaatacttaccatggtgttacaactgcctatagtattcaagagagcaatacgcttccaggtttgtagcctaggagcaggctataccataaagtccaggtgtgtaggaggctacaccatctaggtttgtgtaagtacacgctatggtgttagtcaactaaagaaacaaatagtggtgagagaagagaaatcacctataggtgcacttctcagaacatactctggttttcagcaatgtatgactataaatcagcaaaaataaacggaggtgaaataatagttcctctaactgagtgatgtgattatgtaagaattttagttccttcctactatttttctattttcttccaacctttctgtgaagttactttcataatttaaaacttgtaatgttttattaaaaatagatatgtttgcggccgggtgcggtggctcacgcctgtaatcccagcactttgggaggccaaggcgggcggatcacaaggtcaggagttcaagaccagcctgacgaacatgatgaaaccccgtctctactaaaaaaaaaaatacaaaaattagccaggcatggtggtgcatgcctgaaatcccagctacttgggaggatgaggcaggagaatcatttgaacctgagaggtggaggttgcagtgagccgagatcgggcctctgcactccagcctgggtgacagagcaagactctgtctcaaaaaaagaagaaaaaaaaaagatatgtttacaaatatacagacattaataatggagtctgaggataagagccttcaaagcaaaggtgaaatgtcccaaaagacaagtcggtaagaaaacacaggccacgtcctaaaggcgttggagaactgggatgtgtgagagcaaagaaagggccttgaatgccatgtttaggggcagagattttcttctgtctgtagcacatattttgaattagaaagggctgttgttggagctgtctttctagagattccggagtcggcaaatggcatctaaaattaaatggattagaggtgagtggctattgtgatagtccaagtgtcaagcagtgtcagcctgactatgtggtctcagtgacaaaagagaggacatggtagatgtgagtgttgagtacaagactcagccaatggttgggtataaaccgcctgggagaagacaggactgaagaaggctttgaaggctagattctgggtgatgaatcagagatcaatattagtcacaaaagttggaggaagaatatgtgcagcttatttcgaacatgttgagcttaaagtgtccatggagtatcttgagaagattctgagaagttgcaacttaagagagaagcctgggctggtggtgtggatttgggaattatctgtatagacaggagaggtggtcagataataaaggaggagaccaggaaaggaagagcaggagagggaggaggaggaagaaggggaagaagggatgcacataagacagaaagagaagataggagaagataccagaggaccacactacagaaaagaagtagccgctgacacagccagaagcagcaaacagaaagaggagtgcatatttcaacactgcagagtaggaaacaaacaccaacaagagagtcacccttgatgtgaaatgttatgcaaagttcaaagaggctgcacactgacaagtcgctactggaaatagtgattaggcgctcaagtgacataaaaaaattttaagtaaaaaataagaaataaaatcaacatgtccaatgtcattgcaatagacactttcctgtgggaactaccattttaaaaacacatctggagtccaatatcctaagtgtcaagtcattcctcctttgtccacatggacggaagacgttcatctcttgagtgctaatggtttgaggccaccaccacagcaaccaacagagcaactgttgtactttaactctgcccagcactaactacattctagtctgtggcctgcatggaaatgaagttgttctttcagacactgctgtgtgggactcagtctggctgcaggtgcctgcaagcactgtctgatttgagatattttctataattactggaatgatgaaatctgtcatgcagtaaggtagcaggcaggagacacaaattcattcctagcttcctgaattaaaaataaatggttatcaagtccaattgaatttgttttaattagctgggttttttttttttaagtcacaattttcgcagctcctttatcaaactgactcttccttaatactaaagaggaaacttttcacacctaaaatattcctgtaaagacaaacttgctgggtcttgttcatgtccctgttggcccctaagtatattttacttatttgtctcatccattgcctcatgtctttccaatgtgaactccataaagaaagtgatttttgtgcatgtaatgaactgctgtatccccagaacttaaatcagggtctggcccatagaatgagctcaatggatgctggtggaatgaatttatggaagaatggatggaaagaaaacatacattataagaataaatcctcagaaggatagcagcaccattacagaatcaggtgaaggtgagtagactgaatatgaagaagatatgatgagtgtcccacctatgtggggagaagatgtgaattgctgtaatgagatataggaatataattaattggctttctttatatccagattggatgcagctttgattcttcagcattactgtaaggggatggggcggggaaaatccataataagctctgtgatcctacaaatttcatttcagaaagttagaaatttattaagcaaataagacaggccatgtcaccagcggatcggcatcaggcaaaaacccaacagtgtaattggccaatgctcggaagaatgacataacgaagcttggggttgccatgagatctacatgaaaacaatttctgtgctgaaccataggtagctcttgagtttataaaccctcaagtctcccattaatccagtcttcaataactggatgatttaagtagttacagtattttttaaaatcttaatcctgagagctaagtattcaatcgttttctaaagaaacgcagcaaagaaagtaaaatcaaacaacctgcctcaaaatggcagcatgtccacacactggcttcggtctgaaggcaccaaatgacctgggcatcctctagtatgttgcaaagtttaatcaccactagatcgaaactaaataccagaacacaggtgtgcatcattcaaattggcaaatcaatatattaatactttttttaaaagtcagtgagaaaaccaccaaaatcatttattaaagggaactcaagtggcacaggaagatcttcaagccaagtcccattcatttcccattaaatctgctacaagaaccttaaactgctcccctcaaagaaaaagttagttggacagtgaccagtgagatacaaaagaagaatcacaacgcccaactactaaaacccaggatggttttttaaaaaatgaatcccttgattgagggtcaccagagaagacagatattaactaatcacagaaagaattaattagaagctaggaggagaccagtattccaagccaaagtagtaatctgtgtgaagactttgctggaacttgtattatgtctgaaagattgaaataaagtgccttaatccaaactgggattttcctgactgacatctactagttcttcaggtccccagcctacacataaccacttcaggaagcccttctctactttatcttttcaactaaatcacgccttctgacactacattccctgacgacaccttctaccattgcttcattgaactaaaagaattatctgtaccctcgggtatgattatagagatgcttagtctaaatgcaaaccaagatacaactttagagaaaattctggagcctacagagtagaccagagaagcatctcacaatgaatcctccccaaataagtcttattctttctatatatgtcaagcattaagtaaacacttgagcagcacaagtcacaggcgatccatgctggccattaatcggcagtggcaatatcagtaaagtcaacgctcttccagcatctcctggactaagatcagtgtccagtgtttttattttatttttttccacagtattttgactatctcaagataagcttctagagaaaaaaaatacaaaaacaaatgtaacaaggtcaattgagctgcgcgtgctatgtctggaaacacatgtgccgtcacataatttagcacctaaagaacaagaggctgcaaaactgcatccccagggaagcccagagctggcaaagtaatctctgcagacatgaggaactctgctcacccactttaattttaacgctactatgtacaagcttaaatatagaatcaatcacaaagaaataatacatatttaagcagacacagggctaacgaatctgagccagtacaattctgaaaactttcaagtttccctttctcactctgacatttctaggcttgctaatagtcctcacaatgtccaggaagatccgtgtttccattattccctcctgttatcatacactgaccatatcttgtgtgcctcctagatgattcatacattttcttagctctaaaaatactacagttttagtgctagaataaatgtagagaacttagaagtaaaaaaatgttttgaaggtgagataggaaaaagccaactatcttgaacaattcaaaagactttcttagcaaatctcatttctgagagctttgtatagaaatttcatcatcagctttggctgctatggcaactagatatttcagaaatgatttgaaatgagtatcactacatatccagcatcttttgcaagaaacagaaaagactatgaaatctaatccactgtaaatttcaaaatatagtgttaattttcatttttgaaatctatttatgcttctatttgcaaatcaatagataacaacctggtacgattacatatgagcacgatggagaagtctttcattttagtccttaactgtcacattaaagcatcatttaggtactctcgtcccagttttattaggcctttaaaaaaaaaaaaaggctgggcacagttgctcatgtctgtaatcctttgggaggtcatggtgggaagactgcttgagtccaggagcctaggtaacacacagatacctcgtttctccaaaaaaaaaaaaaaaaaaaaaaagtaaaaattagccaggagtgatggtacacacttgtaataccagccactcgggaggctggggtgggaagatcgcctgaacccaggttttcaaagttgcagtgagccgtgatcacgccactgcactccaacctgggtgatagagcaagaccatgtctcaaaaaaaaaaagacaattttttgggcagttttaggttcacagcaaaattaagtggaaagtacagtttccatataatccttgtcccctccccaacctaccccactatcaacaccctgcatctaagtggtacatttattacaatcaacaaacctacatcgctacatcataatcacccgaagttcatagtttacgctagggttcactcttggtgttatatattctatgggtttggacaaatttataatgacatatatccaccattagggtatcaaatatcaaaaatcaaatcctgtgttccatctatttatccctcccactcttcttaagccttagcaaccactaatcttttcaccatctccatagttttgccttttccagaatgtcaaatagttggaatcacatagtatgtagacttttcagatagacttctttcacttagcatgcatttaaggttcttccacgtctttccatagcttgacagctcatttcattttagcattgaataatattccattgtctggaggtaccacagtttatctattcacccactaaaagacattttggttacttccaagttttagcaattatgaacaaagctgctataaacacttgtgcacaggtttttgtgtggacatgtttccagctcatgtgggttataccaaggattgtaatgtcttgactgtacagtaagagtatgtttacttttgtaagaaactgccaagttttcttccaaagtggctgtaccattttgcatttccaccaacaatgaatgagagttactgttactctacattcttgccaacattcagcgttgtcagtgttttggagtttggccattctaataggtgttaatggtatttcattgttagtttaatttgtaattccctagtgagatatatgtcaagcaccttttcatattcttatttgccaggcctttccttttagccatatctatgccaaagcccaagtcccactgaatcttgcacaacagaataaaaacaaggtcttcaatgatgagttagttgtgatttgatttaatcaatgaaccagccatggttttcacattctaccctgcagagctactattcctgggtcactgaaatagctcatagcaaatacatgctagagcaaagaaagctgtgtggaaatgtaaagtaatgcaatgactggataatttaatcagcatttacacccatgcaccttaactacatatatgtaaaagcatcaaacgagttctcaaattccctgcttaggtcatgacactgaggggttcaaatagaatcatcagtgtttgcttgaaagtccacaaagtaaggagatttattcttgattgaagttttcacagcatgttaccctgaatatttagggatgatggttaagggttatggaggtcaagatgaactggtagagagagcagcatgttaagttgtgtaagtgtttgctgaaggacaatggggaaatggagtgagagacattctgcaagtgtgccacaattcaaaagaaccagcatcctcattaaaaattgtgaatttattaaaataatggcaaagttattttggaagtaaactgatctaactataattctttttcctcttgaaacttatcaattttaagatacttacaatagtgtaatctcttaaaagttttctacctctgcacttaagtgtagaaacaagcttatgctgaccttttgaatagaatctaaagcaatgtgcattacctttatcaattctaaaaggcatttccaacagctcagtcttccaaaaatatactttaaatgtagtagttagtgcaaatgatatatcagaagtatcgagtaaagaagaaaaatactatgacattcatagatgtcaaatatgttagaaaatcatcagcactgtggatcaggagttctgggccagagctgtgggcagaatgggacattaaatggggcccttattaggaagttgacatctgagcaaagacttgaagaaagtgaggaagtaatattcatggtttatctgggggaaagtattctgagcagagacagcagccagcgtagaggccctgaggtgagagcaggcctagcacattgcaggaacagcaggagggtgagtggaacaaagtgaagggggaggatcagctgcaggcatcttaaaactttggcttcggccggccgggcgcggtggcttacgcctgtaatcccagcactttgggaggccgaggtgggtggatcatgaggtcaggagatcgagaccatcctgggtaacacagtgaaaccccgtttctactaaaaatacaaaaaattagccaggcatggttgcaggcgcctgtagtcccagctacttgggaggctgaggcaggagaatggcctgaacccgggaggcggagcttgcagtgagccaagatcacgccactgcactccagcctgggcaacagagcgagactctgtctcaaaacaaacaaacaaacaaacaaaaaactttggcttctactcagatagggagcaccttgggaattttcagtaaaacaaattactttgaaaaatttttcttatcatacaaaattttaaacatgagcaaagtagagaaaaatgatagtatactctagtgtacgtatgattcagtctcaaaattactgattcatggtcattactgtttcatttacactctctaccctaccctcaccccaaatcattttgaagaaatcttctgacgtcatgtcttttcaaccataagtatttcagtagggatctctaaaagacaggcattcttttctttctttctttctttcttttttaacaccactgtaatactattatcacgtccggtagcggttaaatcagctcatacctgctcagccaaagagaaactgtgtatgccactcttcccactcacggacccatgacttcatgaacgtggcttgaaattaaccatgaagggagtgtatacaccatgaaaatccacaaatactaacagcagggcttttatttctagtaataaaattgttaattctttactatctgatatggtttggatttgcgtccctgcccaaagttcatgtcaaattgtaatccccagtgttgtaaaaggagcctggtgggaggtgattggtccatgggggtggatttcccccttgctgttcttgtgataatgagtgagtccccatgaaatctggtagtttaaaaatgtgcagcacctcccactgctctctcttcctccttctccagccatgtaagatgtgcctgctcctccttccccttcggccatgattgtaagtttcctgaggcctccctagccatacttcctgtatagtctgcagaactgtgagtcaattaaacctctttttctaggtgaattacccagtctcaagtagttctttacagcactgcaagaatggactaatgcaccatcacacctctgactcacacgtagaagattaacaatgcttacttaataccattagatgtctactctacacaatggtcatatttctttggtaaacctttttttcagtttgtatgtctgaatagtgatcaaaataaaatctatactctgtgactgtttgatatcccttaaatctctttgaatccataggatccccaacatctctcttttttctggcatttgtttttattgttgttaagggaactgggttgtttgccctgtggagttcttcacagtctgcaattgctaattgtatgcctatggtttcatttaacatgttcctctgtttcctataaattggtcattagatttagtggcttgctaagatgcaggatttattttggggggcaagacttcttcataggtgcaggtggtgcacgtccatcagaaggaactgtcatgctggttgtgtttcatttttgtagtaataatagcctactgatgattctttcaaaatgataatattttgcattctatcacttattcttcatttactattttaaatacatctataagagaaatttatattaatcaatcatttggctaatttacactttattttattaattttttgagagatgagattttgctacgttgcccagcccgggctcaaacttctgagcttaagtcattctctattctccctggctcagactcccgagtaactaggactacaagcctgtgcctaatttatattttaacaggatcactctgattgctgtggtagaaaagactctagaggcaagttcgcaagtgtgaaaatagagaaataatctaggagggtgttatggctacctgggagagccatggtcacggctaaaaccagagtataactctggaagtagagagaagcaagtagggaagtccaaggactgagttgacgcacagccaacagcagttgtgagtgtactggagttatagatttttccacttgcaagtggctcagtaggttcctgatggttaataggttttatcatagctgagatgggaatttgggctctgggtgctacagctgggtataaaagcaaatcactcagcaggagggtgaggtaggggccgggagcgggtgttgtgaagagaactgatcatacaggtttcttgtcttaacaaagctctgagttatatacttaatgctaaataggcagttagtttaaaattccagttatgtacttttgaaagacagcagtggacattaatgatagttactgcgctggcttaaaaataaagaaaaagtaaagaagtctaagaaaaaatatatttgcacatatgtgatgtttgaggaagtcatgagattatcatgttaaagacctacttaacacattttcatcagcactctattattgcctatatttaggttgttcatgattaaatcacaattactaattgtagtaattataatctgttgtaaccctctcttgagctgtcaaaaaaagctgttgtattatttaacaacctaatttgacaagaaacttcagctactatattatttcaaggttttaaaattttcagaccatctgtttttaaatggtacatgcttcatttctttgaagacatctcatattttctcaggtagattcttttacgagtttttaactgctttcactggctaatttccgttcccaagtttttatgaaataatttacaaatgtattttcttttccagtgcttctaacgccactgattagttttctctaacttttgaatagaaaacaagtcgatggagaaacacattcagaaaaacacaaattctgaactccacatcatattgaatctccagtttctagatggagtttaatgtcgtcggtcacccatgccctcgtgggttcaggcatcagcgacgccactgttgctaataagcatgtcagcttcttagggaagggatgcagagaatcggaggacacgtttcccctgagacacttataaaaagaagagcataatcttacagctgggtgggccatgaaggttttccaacaaactactcttcccatcttttttttttttttttctgcaaaggttttcttatgcaagggggaaggggctcagtccctggcagctgctttcctcagggcggggccgggacattgcacaggctctctcactttctcttgggggggaagtgtgccccccacccttttcctgatgaacttgagggcctgtttgtcctgggagagcttgagcaactccacagcacaccgctctatgggacaaagccacacacctctcggggcatgtcttgcgcgattttggtgtttgctgaggcgcccgcttggctgtgccttggtttcctcacgttcttggtcaccttgtggcctttgttgaggcccacggccatggggtagtgcaggaccatggctgttgctctccgagggccgccgcagaggacccaccttctcttttgtagaaggaaaaaggtgtagaaaggggaagtgactttctctaaagtagagagtagccagtagacatgaatttggaaaggtttatgggggctgaagcatggaattcacatcagaataacgagaagagaggttaatggttaatatattttccaagaaaccatgagtagctatattctttctctcatctctttttcacacacacacacacacacactcacacacgtccacacacattcacacaccctcccatgcacaaatacacacacaggtccacacaacacaagcacacactactacacaccctcacacacataagcacacatgtccacacacatacacacacacccttacacacataccctcacatgtacatatatacccatgtccacacccttacacacatcctcacatgtacatatacacacatgtccacacacacgcacacacccttacacccttacacacaccctcacatgcacacacgtccatacaccctttacacacacccccacacaggcacatatgcacacgtccactcacacacacacgcacacattgttacacaaacaccctcacatggccatgtacacacgtccacacacatgcacacacccttacacacatacacatatgtccacacacgtacaaacccttacacacacaccttcacaggcatatatacgcacatgtccacacacatgcacgtaccctttcacacacaaatacatgtccacccaacacatgcacacactcttacacacacatacacccttatacacataccctcacacacttatgcacacgtccccacactcgcacacatacgcacacacctttacacacacatcctcacacatgaacacaccctcctgtgtgcacacacatacacacatctatccactcacatacacacaacaccctagatgcctagtttggaacagaagcggttaactggcaaaacatgttatgtgaatggcgtcccagtattttctttcaaatcacactaacaaccaggtaatgagatagtttgcaagggagaaagagtgtaaaaatgaaagaaaagtacttgcaggcaaatcagtatttgttcacctgttgaatgtgttttgtttgaatagatttttattgaaagattctattgtatttcccatggtttagatatttttccagcttttgtataaatatgaccatacaaaatgctcttgttcccgcccaatctctatttgcaatttactgaatgagtcatttacagagaggatcctgagaccatctaaaatactatgagtgggccctgaaaatgctctctttctactccctcctaatgaatttaagtgtttgaagaaaaacttactaaattcatgcgcctattaatagttccacaatgaagaagaatctaacaggagttcaatgtaaccactgtcatggcagagaaataacaaatgcatattatattttttaaaatcaggcttttttgagtgcatcaattatcctggtacttcccacttagtaaaagcagtgagtaggccctttaaatctatttattaattcactgagcgatctcaacaaactgttaaaaaagctttaggtattcattcaaaccaactaaaatacacaggtatcctttagaaaattaaaatctaggtaaagagaagataaaaagaggatactgattattgatcacccattctacgacgggccttttaataggccctatttataaatcaggtcaacacacgaacgtctccaccattaaatagaaatttgacaggagtaagagcattgtttctctgatgtatcgcccagcacctgcagtatctgacacacaacagatgctaagtcaatacttttgaatgaatgactgaatgaatgaatgaatgaatgagatgtcttcccagagaagtggttagtcccaagctccataacattgggtgggtgtcctcagccaaagtcacatcgcctcagggtacagaaatagaagacaataaggaaatgtgtttaatgaggatttcggtcatgtgttgatactcagctcttcacctcactccatcgactgacttcattcttatgattttatacttaaaatgtttgtgcatttggatgcaaacagccttaccaaggggaaattaggtataactctggagacaatgatctttattcttttttaagggcccgtttcaggcaatgatgccaggctttgctgttgctagggagatagagagaatgtggggggaatgagggggacattgagtgttttctttagcctgcaggccagggcacagtgaccagaatggagaaatagggccagcctgttctctcaatcaaatcccgtacagtccattgagaatagaagtagtcatgattacgttttggtatttagcctagaaccaccaaaaatatcagcctaaaacaattctattccaaatactgccatgttatttaagttgtcaattgttaggaagcatgggggcaattttgtgttttgacacggatatggattaagcacctgggagaagcatctgctctgcaaggtgacagcaacaagcctgacagagaaccagagcaaacagtcttttatcagctggtctattacctgagagacccagagaagactgtgcccagctgtgtgaatacttcagcaggcttgggctagacagctgctgagtgttcttcgcagtttctgtcatggcctggatacaagtgctcttaatctagtagattttaccatgagtctggctgctttttccagcacgctctccaggcctgttcattgattcatgctgcaagtacttacagtgagtctactgtgcggggggccctcttagcttaatatacacagaaaagacacttggttcagcaaagaaaagaaaggaggattcattaatagaaagccagctaatgcacagtttttccccccaaaatgtttgaattttttaaaaaattgcaggaactcacttcttagcacatcaggtctcccttgtctttttgccctctgtcatcttctctaaaccgaggacagcgatcagctacgtgagagtggtattcatgagtgaacacatggccaaaagaggaacacacaaactggtcatggtattttctttgcatctctcacaataacctctcctttaattttcaaggaatgcaagtcatctttagaaaatgacaagaataagtccaggcgcggtggctcacacctgtaatcccagcactttgggaggccgaggtgggtggatcacctgaggtcaggagttcgagaccaatctggtcaatgtggtgaaaccctgtctctactaaaaatacaaaattagccgggcgtggtggcaggcgcttgtaatcccagctacccgggaggctgaggcatgagaattgcttgaacccgggaggcagaggtagcagtgagcagagatcacaccattgcactccagcctgggcaacaagagcgaaactccaactcaaaaaaaaaaaaaaaaaaggaaaaagaaaaagaaaatgacaagaataaacaacataaggtgtctatgagaaacagaaatcacccaattgccctggccatattgtaggctgctgtaaagaaagttcactaccaaaagaaattcttcaagtgccgtggcatctggtgttaagattccaggcatctgacatttgccactcgacaggaaagatatagacaataaagtcatcctttaaggtgttactagaatgctctgtgtaaacttggtagaatgtaaaggtctgaggaacattgtgttataatgttatactttgcagtaccttttcctgtaaaggagtcctggtttactgaaaatttaggaaaggaatgcagattgtgacatttgcttctctggcataggaggcaaggcaaaatgcaaatgttagaattaatctcactttacagcattgcacttaacacacgcgttgaagtagcacagattcaagaatcaccatgattgccttcgttcaacagcttatgacacagtgcccagattccttttaatttcatgtaaaagaatcaatgtgtcaaactggcagagtatcctgaataaccctagtgagtggcattggaacactatggtcggtgctattcacaagacagcattccagagcaggataagaaatgtgtcagctcaaaaacgacattaatcctgtttcgtaagcaatattccattacaataaggtatactgcccaggaagacaacatgtttgctacttctagatgtctaaaaggtcattttctccagtcaaactttcattacaagaagacaataaaccaatatttgtggtcatctttctctttatgaaaaaaagtcaagaacttgagaaattgactgaagtagcaccctgtcttctaatgtagtcaagtctaccatgttctgttacgtacatttatctcaggaaacagtgtatatgaagacctagagacgaaggtgtgagagtgtgtgtgtgtgtatgagtgtgcgtgtgagtgtgtttgtgtgtctgtgtgtgtgagagtgtatgtgtgtctgtgtgtgtgagtgtgtgtgtgtgagagtgtgtgtgtctgtgtgtctgtgtgtgagtgagcgtgtgtggtgagacagaggaagaaaatatatgcaacacaagaagacaggactatgtctttttttttttttttaaacaatgtactgcccacgacagtcacggaagtgatgaaaatccagaacaatatgatgggtatcataaaattaccagggagtcaatgactgcccatgtaaaggagcttatagcagtgactgatgagtgaatcattctcagccttaaatgcttctcttacccaattcagaactgtcctacttcctgttaaatgtgttgttaaccagcaatttttaaattcttaatttaagatccttgccttgctttttaaaattcactattcaatcaaaggggttcacttggctatcaggaatatttttccccaaagaaggctacacaatgcacatttgcaagacagtggtcaaagaaattagccaggatcctttcatctcgatccctggagttggtggaatgcaatggaagacagaggactggatctgactatggttctgacacggactaatttttgaccaacaaggttttcatcttttgtcatcttttgattcctcgcttataaaatatcttcctcaaagcagttataaaaatttaaaatgagataaaactgaaactataggttgaaaagcataagacaattaaaagtattgctactgttagatattttgttagcaccttttgaaaacacaatttgtttttctataacaacttaggcattcctgaaaatcacacaccacagaaaattgagcaataaaaaccacagagcttaagagaaaagaaacagggtgcaacgctctaaaaattttatctgtgccacataaaaaacaaagataggaacctaataaaaacggcagcacagtgtttcactagttaattggctaagaaatacatacatactacaatagttttgtattttcaagacaatacattgtttctatcctgacaaagacctgaaagttggctcatggaagtgagcaccggaagagctaaagcttgtgagttattggaaagtggtagaaagaggattgtctgaagctggagagctgtcatgccagtaggaggtgttatgctcatatccaaggcctgaactgtgaggtagctggtagatgtttgagaaatgggcgttttatatatttctatagggctcaattcagctgggtgcagtttttttcattcactcacaaatgaaactatgcataaacaatcacgaaattcacattgcatgagaattgctccctaagatatcaattgtgttggaacaaatttgtgttttcaaatgagcattatagcagaactgactgtatcatgatatgtgtccccaaattggaaaacaaaaccccaaaataattacatgaaaatcaactggttctctttgttcctgctacttaaaaggagtatatacacggaagaaacacctcagcgcagctctgagcttctctccttttatcagcaaatagatgaacatttgatggtttgaaaaatcaatgacttcagacatgaatttcatcacacctctgtcttcctcagcatattatttgaacctcacaaaggacatttgattaggaaattaagatcaataaccagtagattaccaaatacagggagattttactttcattctccaatcattcatcagattttcatttccaatcttgattcactcagtaaatatttattgcacatttgtaatgtgtcaggccccattctaggcactggagatgcactggtgaacaaaacacaaaaaggtcactgtcttcacgcaacttacattctagtgagagaaacagactacaaacaatggcacattgatacatatacaggccttgtgcttgctttaatgcactttgtagatattgcattttttataaactgaaagtttgtgacaactccgcactgagcaaggccatcagtgccattttcccaacaacaggtgctcactctgtgtctctgtgtcaaattttggtaattcttcccacagtgtttcaaacttgtttgcattattatgatatctgtgatggtgatctgtgatcagtgatctttgatgttactattgtaattgttttagggtaccaaaacccacacccctttaaaatggtgaacttcatccatgaatgttgtatgtgttctgactgctccaccaaccagccgttgccctgtgtctctcccactcctcgggcccctctattccctgagacacaacaacattaaatttaggccaattaataatgctaccatggcctctaagtgttaagtaaaaggaagagtcacacatttctcacttggaatcaaaagccagaagcatgaagcttcatgagagaggcatgtagaaagctaagataagccaaacagtcagccaagttgcaaacgcaaaggaaaagttattgaagaaaattaaaagtgctactccagtgaacacacgaatgataagagagtgaaacggccttattgctgatatggagaaagtttttgtggtctggatagatgatcaaacccgccacaacattctcataagccaaaccctaatccagaacaaggccctaactctcttcaatcctatgaaggctgagaggtgaggaagtcacaggagaaaatttgatagctagcagaggttggttcatgaggtttaaggaaagaagccatctccgtaacataaaagtacaaagtgaagcagcaaatgctgatgaagaagctgcagtaagttttccaaaagatctagccaagagaattgatgaaggtagttacactaaataatagattttccttgtagatgaaacagccttctgttggaaaaagatgccatttaggactttcatagctagagaggagatgtcattgcctggcttcaaagcttcaaaggacaggctgactctcttggtagaggctaatgccgctggtgactttaagtttatgccaatgctcattgaccattccaaaaatcctaggactcttaagaattatgctaaatccactctgcctgtgctctatcaatggagcaacaaggcccaggcaatgctcacagtcacccaagagctctgatgaagatctatgaaaagattaacgttgttttcatgctaacacaacatctattctgcagcccatggatcgaggagtagtttctactttaagtcttacaagttaaaaacaaaatacattttgtaagtctatacctagacagatgtataataacatctatccatgtagatagtgatttctctgatggatctagcaaaaaaaattgaaaaccttctggaaaggattcaccattctagatgtcattaagaactttcataattcataggaagaggtcaaaataacaatattaacagaagtttgcatgaagttgattccaaccctcatgggtgacttaaaggagttcaagccttcagcggtggaagtcactgcagatgtggtagaaatagcaagagaacttggattttaagtggaggctgaagatgtgactaaattgttgtaatctcatgaaaaaacttgaacagatgaggacttgcttcttatgaatgtgcaaaaaaaagtggttttttgagatggaatctactcctagtgaagacgctatgaacatttttgaaatgacaagaaaggatttaaaatattacataagcatagttaataaagcgtagtagggcctgacagaattgacttcaatcttcgaagtccttctgtggataaaatgctctcaaacagcataacatgcaatggagaaatctttcgtgaaagaaagagtcaatcaatgcggctcacttcactgtcgtttatttgaagaaattgccacagccactccaaccttcagcaactaccaccctcatcagtcaacagccatcaacattgaggcaagatcctccccaaggaaaaagatttgctgaaggcacagacaattgtgaacaatttttagcaataaagaatttctaagttaaggtatgtaccttgtttttttagccataatgttctttgacacttattagactacagtgtggtataaacttaacttttatatgcactcagaaaccaaagaatttgtgtggctcgctttattgtcatattcatttatcaaggtgatctggaaccaaacctgcaatatatccaagctatgcctataatacataaattatatataatgttagaaagtaataaatgttatgaacaaaagtagagcgcagtgggaatcagaaatatataaattccctttcttgcaggggatttggtaaaagaagtagagctgtggtcgggcccagacaccatcggaatttgtaggccaaaggaaggggaattcactgataattttgtgtaggctgtagcatgagctaactcaaatgtttaaaagattattttcactgtactgtagggaatagatagaaggtaggaactatgagagccacttgggagccctttgcaatagtctgtgcaaaaactgatagtagtagcagtagaaatggtttaaagtgagtagagtcaagatatattttaaagttagagcccggggaacttattgatgttgaagacagagtaagaaaaaggatggcatcaagaatagcttcaaggtgttttattcaaacaatgaaacagtagaagctttttttttttcttcttcttctttttttttttttttttttttttttttgagatgcagaaaatggcaagaactgacttggggctgagggagagaggagtgccagaaatcaagacagtcttaataacagccaaagatcaacctaagaatgaaaagggaagcttcagcttgaattatttgaagttgaatagtggtcagtttttgttttttgtaattaaagtggacctcctacaccttgcatcttccccagccgtgctctcctgtcaacaactgtctgatatctgataatagctaatccctatagccttgcaatttcagaatagggggaaaatacatttaaaaaatttgatgattaaaaaaagatagtgataaccaagccactttcttgtggtactaaacatttgaatgtagtctctaatgttattactttttactaattttagctaaatacattccataaaaccaacaactcccacttactgattttcctgctccaagttctaacaatttttgtgaagtctctgggatcttctacatataaggtcatgtcatctgtgaaaagagagaattttactccttgttttctgatttggatgcatcgtatttccttttctagcctaactgccctggctaggacttctagtgctatgctgaatagaagtgtcaacagtaggcatcctcgtctttttttctgatcttagagaaaaagctttcagttttttaccattgagtgtgatgtcagctgtgcccttttcatatacagccttcattatgttgaagtaaattctttctacacatatattattaggcatttttatcaataaaggttgttacattttgtaaaatgctttctctgtatcttttgagatgactgtgtgatttttttccttcatttgttgatatactgaatcacattaattgatctgcacgtggtacagaagtagaaaaacaaacttagtttctcctactctactttcataacatgcttctgacactcattgcggggggttcttccccacacatcaagcaagcaatcaattcttgagcagacactagctgtcctccagtacagtcctgccactatctacctagagatagtgtttccatgccctctgcaggcatgccaccctccaggaacctccaagtgttcacctctctctgaacccaggttttgggggtttggggagagtgctgttacacagtcatgattgactaaatcaccggccactgaagaccagctcaacctttagcccttctcctctccctggaggtgggggagcaaggatggggctgaaagtccctaccttctaatcatgccttggtctttccagtgaccagtccccacatcctgaagctacatagggtagccagtaatcagtcaactcattagcataaagagatacttaatactttggagattcccggatttgaggagctgtattcaggagactgatggaagaccaaatgtaagtatttcacaataccaaacatgtggtgaggcattcttgcatcccaacgacaaatcccacttggtcctggtgtatgatccttttaatgacctggtgaagacggtttactagtattgttttgagaatttttgcatccatatttatcatagatattggcctgtagttttctttttttgttatatctttatctagtttttgtattgggttaatgctggcctcataaactgagtttagaagtgtccccttttcttcaatttttcagaagatgaatgtcaaaattccatttgtttatcaatgatgtgagccacttttttgttgctgaatcagatcatttaatagttttcagatacagaataatatatgtgtttactattatgtaaagtaatatgtaatagtgaaaggcattaatgcacttttaagtttatatttgcaatgttaacattttctccatcactttctgaagtcttgacagctaataaaataatcaatcaagcactgatttgtagtgtttgctgatttccctggggtaaatacaaacaaaagtatttgcacgtttggaagctgatttcaagcttccaatgtttgatatggagcccagagatgggaagaaatgagcagtttatttacaagatgtaaacaacctcaaaagcacagataattgtaaatggagtaaaaaactagaaagttacaagttttgagtattgcttccatttaatataatttaatgaactataagtttatataattgaatagttaatatatactgtttaacagccaacatgtgaattcctgagaatttagcaattggctcctgtgaaatactacaagccagctccagcacaccattgtagcttggtctccagaaaacaacttgttagaattatttggagccaaatatggggaaaggaccttacccttactttctgcattcctcttttcttacgtctccctatgtgcacaaaggaagctactgtcaactcttcagctgaatcaaaccccaaatcctgaggcaggcttctcaaggtctcactgagaacccatggcaatcaggactccactcccagccacccgggattccagtaatgaatttggggaggaaagatcatcagtggttatctgcacatcaaaagtatgcaccctttgaaaatatcatggaataaacatctctgttgctgacatcattagatgtatctttttggattatcaaggtttcagacttcagcttcttggccactcatcagttgctgctgttggatatatttttaggttctaaatatatcttacagggacaataatatcatcatctcctttgccaaagcagaagataacatttggcagtaaacactgaatcatacgccttcccagttcttccgagatttcctttcaaggccttggcttttccacataaacaatatcctgtcttgggttttccacaggaaaaccatctcctgccatcttggtgcccctcactcacttcaccttctcaactgagaggctgagcataatacttactccttgaataatacatttgtctacgtgttacagacatatcccctgtcactcaggaggtcctaaccagagagtaatcattctgatagaaatgggcaagtaaagacatatatagacaaaagattaaaattgtttggtcaatactggaatccagcaatcacacactaatggaagtatctcagtttttaagataatggtaaaattatagacatctataatatttcacattaaatataaaatgagacttggttggaatctatcacgtagatgacatcaaagagctctccactgtaaaaagtcatttcttatatttgacatcattttaaagtattctatgtgcatatatgcccttgccagcatctaaaaggcttctatcctgagaaatttctttcttttttctttttttttttcccagacagagtttcactcttgttgcccaggctggagtgcaatggtgcaatcttggctcaccacaacctctgcctcctgggttcaagcgattctcccgcctcagcctcccgagtagctgggattacaggcatgtgccaccatacctggctaatttcttatttttgttgttgttgttgtatttttagtagagacagggcttctccatgttggtcaggctggtctcgaactcccgacctcaggtgatccacctgcctcggcttcccaaagtactgggattacaggcataatccaccatgcccagactatcctgagaattttcaatgtagagctattgttttataagcaaaaatgatcaacatttatattttaatcattataaagcaatacatattcgatttgcttcatttacaaaaggcttcctggacttagccctttaaaaatgcacgacacttaatttttttttaacaaaaaagcagaaaaagatgatcaaacgaaggatactgatccatcaattactcctcaggaagacaggtggatcatgtgtgatttttcaaatgtttcaccagattgttaaaatgattaaatgaacaacctaagctcaacttgaaatccatacagatgtgatagcaccataaccatttcttaccctctggacactgtagtatggttgcctctggcatctttaacttggttggctgataatatttaatataaaaatcttcatggggtgtcaataaatgttagctttctactccctttctacaataaaagccattaaatcatgatttattacaaaaatgtgacttgactgattttcccatgttatacatccatgaaatgtaaacatgaaatgctaatataaaagaaaaatacaagaatatagattttactgttaatggtgcctattaaatgttggtataaaaataccctaagaaaatgcaacaaaatattaatggtggtagtgcctttaactggagggattaaaggtgatgtttccaagtttacataatgattgtgaaatactcctgggatagagaaataaaattttattaaaaatattattatgtttagagtcagggtcttactttgtcacccaggctggagttcagtggcaccatcatagttcaccgtaacgtcaaattcctggccttaagtgatcctcctgcctcagcgtcccaaaatgctgggattacaggcatgaaccaccatgcctgacccaaaagtttatttttaaaaacataaattttaaaaagataacataatcatatctcacttcactcattaaacatattctagaaaatgttttataatttaatttttgtttttaaaaagttcgaaggccgggcgcagtggctctcgcctgtaatcccagcactttgggaggctgaggcgggcagatcacgaggtcaggagttcgagaccagcctgaccaacatgatgaaaccccgtctctactaaaaatgcaaaaattagctgggcctggtggtgtgcgcctttaatcccagctactcaggaggctgaggcaggagaatcacttgaacccgggaggcggaggttgcagtgagctgagattgtgccactgcactccagcctgggcaacagagcgagactccacgtaaagaaaagaaaaaaagtttgaaaatgtcccaaagaagctaactactctccctgtgttttcccagccatgctgaattacttgtagttccctgaagcatcatgctaattccaactctgtgccctaataggtgctgttgctgatatattaggccccttgctctatgttcctcatgtaactatgagttttccttcaaaaccttccccaggaacactttctgagttctccactacaatataaatgctcatccttcggagagatccctcaatgaatttatcaacagtaagcactatcacactataataactgtggaaagtgatttaacaaagcacagtgccttctgaataaagaaatgaatgaatggataagcaactttgacactcccataacttaaacaaatggttgacctttttgttttctctcacttaagtgactggctgtttgactcgagtagtaaaaacaaactaggtgtcttgacaccctaaaaagggtgaatgttatctacataaattcaatctatacatttaattaaatagtatcattcaataagcattaactgatggcattgtaagtgccaggtttggtgttaggcactagaacatggaaaggaggaacagtgcttctttcctcaacaaactgagactaacaggaatagtcaggcaaatccacagttgcagtagtgttattaagtgcagtgttgaagcatgcactttctgtagcaggaacaaaaaggggtgctgtggggtgtggggacaagccttcttggttccaacactgtgttaaactaaaatgtagttgtatttacaatacaaagcttaataaaggctgcactggacaattgcctaatatcatcaatgtaaatacccaatgttatgtgattagaatgggcataaaaaataacaaaatctgctgttattaacaatgattcccactggaatattggaagacacactgactatcactcactacagaaagtatagaattggaaaagataattttatgaagatttataaacttttaaaactggtgtgaaagtattatttcccaaattcagtttgtagctggggtggggcgagtaggtagtataaatttcttcttaaattgtatcatgacagagaagtgttctttaggattccattgttgtggactaacaaagtcacttttagatatctcaaatttgaactttattgctcttcctatcttccaaagaaatgcactgaaaaataaaatggtctctctacagaagaaccaaaaagcacaagcagttttttttatcctcacagctttctgttttcaagcaatttggagtccccaggcggattcaaactcgatcccccttccacctcactcgggctctatgcactcccacagataacgagattgggtgagcacatcagattcactttccaaaggcacactgaaaaatcttcatgcagattaaaagatttttttaactatttcagcttccacatcttccaaacttctctttctcaaaccatagaacactatcatttgtgcagaacaacatgaagatgggaggttatggttccttcaattatgtctgagaattaagacatatgttatatatttactatgaaccttaaagaataaactgcacctagatctaataaccataattctaaataaccttctataatctattatatacatagtagccagatagacttctaaaaacatagctcaatcagcgctcaaaaatgtggcactgattgacagtgtataattctcactcattagttgtggaataaagtccaaaccgccgttctagaattcaagctcctcacaaactggctccaatctgccttcattgttgattaaccacatgtcccttgcaaaatctacgctccatccccaagagactctgtgttgttctctgagcattcagagaactcttccacctccatgtctgccctctcacggtttttcccacttgactaaccttcctcccatttcacctattcaaacctaactcatcagaagccctcctctctgaagcctgtctagattatcccacctgagagcaatgtctctgtcctctacgttctcactctgctggcatacatgtctcttgccacctctaccacatcttgctcacctttgtaagtaaacctcaccttgctcacctttataagtaactgttgttagcacatactaggtgtacaacaccacacctataagtgagtggctgaatctttttacaaaatgattcagaaggcatctcaggattatttcatttctccacataatcacacatatcgactaccattatttgatagattcagaggttgcaagatattggttgactatatattcactctttaactgatactaaaagttgttttagccagttaatctctaatagcagcttatctgccacttatttgattctcatataaagaaagagtattaaaaatctgatgtttgaatatcctacttacataaattcaagaaaagcaggggtttagcatatctgccaccctgaattcaattatctactgcatgtgttgtctctcatgtgtaacctgggccttgatgctaagccacccctcagagattctttaagttccaatgtcagaaaatttgagggtcctatggcatagaatgataagtaccaacatggttactactgaagatgttagtttggaaatacttttagatcatggagtgcttaagtgctatacagtcatatcaccaatagccttaccttttccacaagattttttttaacaaaatgtaaaatacaggtactgtaattcatgaattctcacataaaggacaaataaaaataggatcatgaatattgctcagactttgaatttttatactgtaatctaagaatactctgaaggacacaaatcaaattggtagggccaggaaataaaataatttctaaattctactaacagtaaaaaacacaaatataaatcttattaaggcagaaaataaaaaacaagagattttcaccatttagtttcatcgtttaaatatcatatttattatcatacactgcaaactccccaaactgctttgatattttcccttaaaaataagagagaaaacatgaaggcatctgattttgtgataatagaaaatttcttgataatatgtttttgtggctataagtgccaatgaatatatcaagttctaaataatatgcaatgttttaaataccaatgaatgttgtgacaatttttttcatttaaattgtgatgtatgtttgcaagatacagtctacttcctttaagctagagaggcgcctgtcagcgcctgtggaggcctaagaggaggaggcttacaactgcagtcttctccttcctccctgaccccgttgtaggaataagaagtaaatcttcagtcagaatcagcccatgcacacacaagccagtggcaaacctctgcccaagtattaaaggataaactgggcaatcagatttgaatctcaaaactctggactaggaaatcagaagaatgaactactgtaagtcaatgatatgaacgagtccaagagacaaagtagagggggaaagctaatcagtagaaaacaggcagatgaagatgcctggagagaagcagagctgccaacggagaacagacgcgagagctgtccgaggtcctgataccctgaggttctgattccagtcaacctgcagactcacatctatcctgaaatgcaacccaactccaattccacagagtcacaatgtacctaaattatttggacagacacagaagtcataataatataatttaacctactgataggccctgtgacaaaaaggcctaggcaaatggtaatttttaaaagcccagtctgcctgagactgaagcccagctctgtcatttattacctctgtggccctaagcaagttatttagtctctcttagtctccaatttatcatgtttaaaatggatataatagcaatgcctcaaagggttgttatgagaaatgcgtgagatgatgaatgtgtagtggttagcacagacggctccaatgttagacgatgatcaggagcatgatggtgacaacaatgatgataatttccttttccacacgggcatagtagctcaatagagaaataaattagctttaaatttaaactaactctatttacttattaccagcttgttcacttaagaaataggtagactattatagttaagattttaaaccttagatgttttgccttggagacagtttgggatgaaagaaaaatatataaaagcaaaaaaaacaaaaaaaaaagcaactttttacttaaaacctagattctttatttttcttcctaccaccacaattgattctaaatctcatgtataatccattttctctgcaaaaagtataactcatgcactcattcccttcatggagactttatgagggcctcatcattgaactttctgtcttctaatacgtgtaccctttttgcattgcatcagaagaaaaacttctaattcacagtcacctctaattaaatactcttctggaacacaccactgtctgctgaataaagaccagatttccttagaatgaccatggcaactttttacagtctgatctcagttcctcaattcatcccctactcatccctaccagcttttcatggtccttcctcatatctattcattttctctggcttttttccttgcccaggatctttttctgacttacaggtctggataaagacacaagtttttggcctaagtcttaaggttcagttcaaaagctctttcttaataaaatgcctcttatctttatactctgacctaatgattttcttttccttggtcatagagtattctgtatttctattaaaagacatcacattctactataaagctatggacacatctttccaaaaaagcagtagctatattttaaataaacagtgataaaaaataattgtgaagttcataaacaaggtaaccctgatatgggaaaattgttggtaaacacatttgaaactattccataggatgtattttaattcctccatgttcccatccacgacctgactctaaggagataaaatagaatcctgttgctacgggggaaacccaattatttaaacaacaaagattttctctagttcaaggtgaaaaactttcctaataagttggtgctcttgagcacaaaaagatgaaattagatataagggggaggcactgaaacccttttcaatgaattcttattgagcgatcacagtgatccaaactagcagaggatccttgtgcctattagttacacagaactcataggccaggtactattttgctattgaatctgcagtttggctctccacagttactcacgctaagctataaacataaaaatgaaaaatgaccataggacggtaaaaagggtactcatattgatgatatgagaggcatctttcatgtatgcctaacacactgccagtcacaggtgcacacacttaaacctgctttcaaataaatctctactgactttcactaggaaaggagaaacgtgtctgttggcaagaggttctcactccatttgggttattggcaacttttatacagagaccatttggcagactccatgacatcatgcagggattttagatctgatacttgttgtgcatgcatctctcatgttttaggacaacattctgatcacaaactattctcctttttttcagttatcatcaaatattgagacacatacagaggggaagggaggaggaagaggaggaggaaatagaataaaatatctgtaagtctcttacaggaaaatgtaatttttctcacttctccaggcaaacaggatgacttggaacaaccgttacattttttcttttttttcactatgctcctctgctctctactcaagaggctaccctgttaaataaactaaaatacagagtgatcggatctactgataaaacaaagtaagctctttgttgcttcacccagcaaaggtcactttcccagtggctttcagcttccccaggaaagtcataatactttccaaagcactcacattcccccgcctaggatgtgtactcaaacagaggtgtctctaggaacttcatctccggtttcactactaattggaaaatactgagggacagaagaaatccctcagcagtttcctcctgggaccctggttgcgtacgtacaccagctccttagtgagatgcaaaggatgaccactgttaacctggcttcctctcaagatcctccagaaagaattggataaaccataggctaccttcttgctctaaataacctcctcttcaattttcacatcagcttattaaaggtagagaatcctccagctataccacctgctttctttgtttctccgtgtatcagtaggcctgtctacaacagcattaccaaattgtgtgtctatttattgtctgtacttcaccttgttctttaaaaactgtgtttaatatttacctacattattatttgccctatgttttatcttttaaaaacatggaacaccaattagaaagacacattaaatgtcaacaattagtaaatttcagagaatcaaaaataacagtagaaaaagtaggattaagccaggtgtgatggatcacacctgtagtcctagcactttgggaggcaaaggtgggcaggtcgcttgagctctggagctcaaggccagcctgggcaacatgttgaaacccatctggcacacacctgtagtcccaactactcaggagcctgacgtgagaggatcacttgagcccaggaggttgaggctgcggtgagctgagatcatggaacagctccccagcctgggtgacagagtgagacactgtcaaaaaaagagaaaaaaaattaagaaagagagagagaaataagcaggaaggaaggaagagagagagagagagagaagaaaggcaggaagaaggaaggaaggaaggaaggaaggaaggaaggaaggaaggaagggagggaggggaaaggaaggaagaaggaaggaaggaaggaagagaaagaaagaaagaaagaaagaaagaaagaaagaaagaaagaaagaaagaaagaaagaaagaaaggaaagaaagaaagaaagaaacacacagactaagatcaagccataggtacaggtaggtaattagaaattagaatacctgccatgtaggcccttatactctgttagaggcaggccatagatatcaacttctgaacctcctggtgtttaaggacacatgcctataggaaatatagcacctgaaataaacttcataaaactgtttattatgaatgttttcatattgcaatgatgaaggcaatgaactaaatagcctaaagagtaaaaacatgttattatgggattccttattaaataatacataacaggcaagaagaaaagccaacagcataagttttcataattcaaccaagtatagggacatcagttgttacttgagctccatcatgtgtcattattataatgacagaagtagcagcatcaagaactagatccccacaatacatctgtctgagagcctgtatcattcattgccaaatgtgataagaatgtgaaagaatgctacactgataatagttttcatggtggaaagaaaagaaaagccattaatccagagcaaaagttagaaataatcaagaataaacgtatgtaggtatgttaaggttttatgactatacatttacagatgttttttaaactcttattattgaaattcctacaggaaaaatagctataattacagatctaaattatcctttttcccaatacaataattatgcttaaaactcaatttttgatagaaaaaggcttcttagagtacagctaccacattctagtacagactgtaaaataaagtaaccatattttcaaagcagaaataacatatggcttgaaaaataatatatgaatttggaagtttgtttttataaaagagtacaatttatgtacatattaaattacatttgattttagatttaatggctttttggaaaatttttatgaagtcaggattgttacaggaaaatttggaatgtagattttgctagaggtggatgctcttaaggactgtttaaaaaaaaggtctcacccaagtttttcataggaatctattcctgttcacatttttttgatatgtggtaagggattgtatttggagtcagggctttgccactggctagtaaccttgttccaatcatttagcttctagaaagttttatctccacatatgtaaaataaaggaagacctggtccactgcatgccttacacttttgtgatgctgtggacttttgagaagaacactgctcacttgtccactttcagccacagtacagctgcttagctacaagaaactacaggcccagctccactcctaacatgggattcatatctgtcctagtggactggaaatcaagtctttgtgccaatgcaaactcacataaccatactctgatggccagcactttgaccaggttaatttaacctgtctaaattttcaccttctgcctgctcactcctctaattttcaccttcccatgaccagctggtatcatggctgtctgttttggtgactgacagctagggactccagcatggttttttatctcctaggcatggctactatctgggatgcttgctctaataccttacactgtcttcttgtaacacagtttcttaaggcttgtgtctctatagaaacatgtcagaaaatgctatcttattatccctacccccaaataaatctacagtggggtcatttcatttatgaaaatactctggaaacaaagttgatgctcaggcaactggtctaccagggatagcatgattttttttttcttctctgcaatacctatgcacaaacttgtatctagaaatcaacaataaatgtgaaatggaagtcattaccactcaccgtcacaaataatgttttctttcattttccatatgggcaacataaaggagtgaaaataaccattgctgttatgcacttggtaggtttccatctaataaaaagcttcatatctgtaaaatgccaataacattcagtctatccttcctcatttccaacttcgagatctcatttatcccctactgttttcaggggttgactgaacttgtatccacaccaaaaccttccatgcccaagatactagtgagttacaaccaataagtattaagagaattacagaaattttgcatatttactttgacaggatacaaagatactatcattagaaaagtgagaaaagtctgtttgagtgggaagaaaagcattctgtcaataagatcagaacatgtacaatagtcagttggttgcttacggagtttaaaatttccaaatgctttagagcccagttatactgcctgggagtcttcagagatgggatacccatcactaatattaatattgatggtaataaaacctgtctccttccagcattaccctacacaaaagagttcttcttgtgataatgcaatgaagcgctaatcctctacaaagggctcggtgatatcagaataccatacgttccctttaatgttattccataatgaccataaagtgcctaattgtcaataaccacttaagaaacaggttctcttgggtccttaagtgctggataatgtggtgctgtcctcagtaccaggtaaaaggaagattttttttagctctaggaacttaggtgaaatcctggaaacatttgacaatgtttcttgtgtgctgctggtggatggatcatagatataaaacatacatgatggtttataactaggctttcccattgtatagcagcaagtgctaatcaataagtcaataaaaacttgatggcaatttttctttgttttttttttgtttgtttgttttttgttttttgtttttgagatggagtctcgctctatcgcccaggctggagtgggtggcgcaatcttggctcactgcaagctctgcctcctaggttcaagccattctcctgcctcagcctctcgagtagctgggactacaggtgcccggcaccacactcggataattttttgtatttttagcagagacggggtttcactgtgttagccaggatggtctcgatctcctgacctcgtgatccacccgcctcagcctcccaaagtgctgggattacaggcgtgagccaccccgcccggcccttgatggcaattgctaactcaagtgagggcccataactctctcatctgatatgacctgctattagtggtagatgtcacacatctgagggtgaaagggaatataccacatgatctatcagattcaaaaaacaacatgatgaaaagccaaattgaatttaataacatgtaattaagtagatttatgtataaagccagtgtgtgggtttaaataacccatcacttgaagacataccagttatacagaagcttatctgaaacaaacctgaagtctccctttgactgcaagctcagtgtgacctgaaagtgtaacggggacaataaaacaatgaagctcttgaaaacactcatgcattaacagaattagagtatccagaaagtgggttgtaaaagttccactgtacactctattagtcaagctacccctatagctatatttgtttatggaaactctcttccaccctagaatctaaaggcatatattcttccacaccacacagcaaaataaaacgctgtttctcaacagactctggggactccaacagcagggagggaggtgtcaggggcaagggttgaaaaactacctattgggtactatgttcactatttgagtgatgctttcaataaaagtccaaaccacagcattatgcaatatactcatgtaacaaacctgcacacataccccctaaatctatttttaaaaaccctgtttgtatttacatgtaacattgattttcattggtccattagtacatctctatttagcttgacttttccatgattcctatattaaatgtgttcttcagtagaattttccttctatttatttaaactctttgttccagcaaatgtcaaaagccaactaaagaggcactttaaagatgctgccaacttcagatcctctctatcaaaaatggaagaaagtctaatttaagaaagagggtatttccactcacccattgtgctgctgattattgaactggaagtaaccacaaggtctgcaaaacctctgaacttcattttgaggaagaagaaatgctagtcaaaatttacttagaatctattaaatttaaagtattataatataatgattgaaagaatggacttaaaaaaaatctaggtttgaatcctggctctgctacatgcaacttagctttggcatgttccttaacttctccaaatctgtgagtagtttaaggattaagttattaatatatagtatatgtaaagtgcttagcatagtgactcacatatgataaaggtacaatatagtttcactattatgttgctgccattgatattatattattattattacttattcacttgcatactgtgagacaaagtttagacttgagatttagcaattgtgtttgttactctagttctgtatttacttactagttacacctaatgcagtatttctaacaggaggaatgtaaataagccactcttcaggggtagagctcttgacaattttactgtcagctggaaatttgaccaggaatgtttcagagagaagcaaaatgagcaatacagcttctattcagatatccagagttagggaggcgtaaggtgattattcattcattcacagcagaaagatgtatggtaatgcagagacgaaaaatatcagtgtcactagagaagcatcaataacatgctgagggatttcagcagatacaggaggaaacctgctggcctgggaatgtttaatttgtaatggactaagagaacaatcgagtttccaaaattgtactttggctacttccattgctgaatttcctttccagccactgccccctcgacctctgttacagtctttacatttttatgaggttgactttcaaacatttattccaaagagcaccgtgtagtttttaaaagtaatcatgcaaggaacagtaatggaaatcgtaagcacaggactggagttaagtgaagcatcagccagttaggggctgtctagaggaggcccacaggaaggataatggatctgcaaaccacatcatgtgacatatgattaaatgaaacagaaacattaatcctggaaaagagaaggcttagggaggccatgattgatgttttggtgtaggtgacgtgatcttgtgtgaaaggagattagatatcctatgtaaatccagaaatgtacattagaaccatgggaaagaatgccagaaaaatagattttatattaatgtaaggaactaatttataatcgtttgaggtgtccaaccaagacttcctcctgaagatgtggactccttcccactaaaagaagtcatagagagggagaaaattctggcatgcgggagagggaggactgaatgagacaacttccgcggccccttcaccatctaagagtccatgaagtatctaacacaacgaaacatttcctttttagagaaaacctaattaattgtggaaagctgttaggaaaacttgattgtgttttatatctcccatctgcatatctgtaagcaaaccaaaagcagaaacttactggcagcttcaccttctttggcgagtttagtattgtcaatacagtaaagcctctcaattctgcatgcaatttgacatgaacagaaggaagaaaaaaaattagaattccaccttcagaaccacctaggagggtgtctgacattgaacaggtaatgaacaatgaacaggaccatttccccagcagcctttgttttccctgccacctgcaagggatggacagttttatttcacaatgatgaacagtgatgtcgggctgagccctccactctgtctcaattcactccccacctggagggaaagggataacaaatacaaggtcttattttgtttttgaagggtctttcagggacaggaaaagcagctgttgtagtttagaacagacttcaaaagcagatcaatagagagccagacccaggtgctccttaaaggcatcgactgctacaatattgtcatttgcctcccttagctttctctaccactttcctctcaagccctgctagactactggttttgatagagtaacactctgttgtgagatgggattgtttaaatgagagaaagttcacatgtggaaatctgccatggggaatctagcagtaactagatatgtcccatttgggtcattccaatttttatttcaagtctgttagaacagatgtattcaaaatgacatctagataaggccaggcggataagaagagacttcagctgggacaagaactactttgtgagttagaaaattgggttcatgtttccatgtttataatcttggctaagtctgtaactgatattcctcatctaccatatacaatgaggactgctgtgaggactaaaaggaaataatatctctggaaacactatgtaaaatccaaaacactgtgtaagtcttagatacggcactcttttactacacataatggtcatggtttgactgaaatctcaacaattttacagcgaattaagggaattcactgtattttcttattttcattaaggatattaaaactatttatatagataatatactctattagcaagattattaaaaagcaatttttagctttagatatcttctccagtacaaagcttttctctttatttttgcatcttagttgtctcttcttaacagaaaaatgatcctttgtatttccgtatgttaataagtttctgtgaaagttagatgacttccttacaaatagtaattaatattattgtaatagcaattataatattatagttttataaacattggtgctgtgatgtcaaaccagattaatatattgatctgtatatacatatatatagtatatacatacatatatgtatatgtatatgtatatatgtatactcttgaaagtattttagtactccgtcgcttccccaaaaaggtaaactagatattaaaactctacctaggataaacagataatggacaagaagagtaaaagctttttcacaattcttagcttctgcactgaagttatgaagatcgtggttaactaaaaagttaaaaatctttttcccataaagagtaatcaagatttccactaatcacaaggccggtggttgaaatagcaagattcatcctcaggcttgcactttcttgttgctggagagcaatggggatggggaaactctcggtaccacggtcctgggattggctgggtcataaagatcattccacaacatgggattctttgatcatctcagtgatactccccccagcctcaaatgctcagggcctctgagccagtccacctctcagaagaggaaacctaatatcccgcaggggcccattccacagtgaaaggctgttagttggaaagttctttttaccttgcagggcaatacagtgggaagggactatccagtaaaactcctccaaaacagtagtaaccactcaattcatgaagttctctttctatactgcagttttctaaagtaacataaaaatatccatggatttttcactttcctttgaatgcggtgaccattccttacctttaccaaagaaattgcaagaaaaaaaatagaaaaaaaagagcatctcttggcaaaaggtcccatcagtaattctagttatagaatcccttcaagaatcattaattgtgttacactacagaataaaccaaatatttatttctgcaagcatcattaaattatgacatattagaagtcattaacaatcagcaggcaagggcactgggttctgccagtttaatgttctgaacaatcaaaaataatatccatggggcaattaatttcctgcacattgattattccaatctccacactaataagtggggctaaaccaagtaaaatcaaaacagcacagcaaaaaactgcagactgatcccacttgtaaaggggagtctgtaaccttgacagatgaattgtatttcctaagttatagggggagaggaggaagttattccagcaccctaaatggtatcttgaggagctagcatgatccttacatccactatacccctttcacacacagagatacatgcacatttcacaaatgtaagaattaagattcaacagattgtccaaatcaagcccctagtaataatgtcgggaccaggatctttggattagttctatgtactttccactctgtgggcaattcaatggatgtttaatgattctggaattggagaaaaaacaatttctattaattcaacaagttccacagcaaactgcaaaactgccacttttctctgggtttgaggaactacttattcataaaatattagtcaaccaatgtatcaaatctgttgttaaaatgttatccagaattctaaccctttcttccttcatacattctttaatctgtcaggcatttaataaatatccactaaatttatcaagtgatgtgttaggtcctattggaacacacaaaaatcacaaaaagatcctgttcttaaagagctcaaaagattttaaaacacacacacacacacacacgcagagtgatgtgctggtagatgctcttcatcaaccagttttccaggggctgcaggagaagccttgatttacagcatttgccacttcccatgatacaaatactccaaccatggctaatttcaatttttcaacatcaatatggggttgtggattcagggagatattaaaaactgtctaaactggctctagtgcaccactactgatacactgctgatatgagtgtgtgtttcactatataaaagaactaatcaaatattttagagttgttatgttagagtagtgtgattatgattgcttcttcttcttctttttccttttttttatagcatccaacattttttatgaagaagactttttttaaagataagtactagtagcaagattcttatcccagaccactttttctacatagccttggtataaccaaaattatctgaggagtagagaggctaaaatattttgatggcacatcagattcgctttagagccacatgtcccagtagaactaagaaaggaaatgctgcagagagtgtccaacttctaagaggcatcatcagacttcatttagcactaagtcttcctgagccccacctatgtgaccatatgaccacctagatcttacaaaatatatttgcagagcatgccacctccacacattcttaagattttgaaatattcaatcataggatgtatgtgaaagaaggggaggaagtagaaactaagagaaggataatccctaaaacataggaatccagacagaaatattattgcttctgcagaaaccctaggacaggattgaatgactcaccacctgtttggttttatggttacatttcaacagtgtctgcagctgtaactcatgcttcctccttcggctttcttaacacacagatgcactctgttttggaaccaaacatctttgtcccattccagaaactcttttctttcttaggactatatgaatgattaaccctgtaatcttcaaggttatttattatcatttttaatgtgaagaagtggaagttttgtggagggaaaataaaacgccttattgcttgcataacattttaacatttatgaaacaattgcatgtaacttatcacagttatcacaataatcctctggaataggatattcctggcaccttcatatgtgaagataaagaggctcagagagtttaaaagactcactcaagttcacaaagccacagagtggtctctcactgccttaaacacatgggcttcagaatccatattccaacccagtagggaagtagcttggtatagtttagagaaaaacaagatgtggagttaggcaggctagatttcaaatcttgacaccaccattttccatctgtgtgatcttgggtaaaatccttacactttctaggcctcattttcctcatttgtagcatggagagatgacactcaccttactggactgttaggaaaatcaaacaaaataaaatttggcataagatgggttctcaaaacatttcttttctcttttccaccattctgtactccattgttcatgcctcttgtccttgtatcatccttagttcaaacatactcattttgtttcttgccctgactcaaacggcctctccagttgaacaaccagaagttgaacaatcatttaatggacagtgtgttctaccagagtatattgctgtagcaagaattagaccccacacaattgggaaatcagggaatcactgcagtctaacatggaagccccactggttcctgcacaatttttcttagcatactgtatgttgtgccaccaagacacagcagctcaacacaaagtacacacagctaggaggatggacaagtcatgcagagatacagtactgaatgtgcggcccattataccacgctcttcctcttggctccatctcactaaatgcacggtttccaaagtatttattgcacacttcaatgcacaaaacacacaagcaaacactcaagaaggagccagaaccgttttatactaagcctgtcactgctcctccacctgcaaattctggtgccaatgctcctctgacttcattttcataactcaggcaactcagtacttccgtacatactcttccaccaacctaccttccccttcaatttgaaaggtaaactcttttatttactggattatttatttgcagggacattaacatgttcttataattgtgctagtattttccataagctcactattgttttggttagtgtttaattataacattaaatgttttgagtgtttaaaatgttttgagtaatctgttccaattctattttcctcaaaacgtcagttatttttagtgagtgatttttcagaatgtgagatttttaaaaggaatacatgcattatgtgatggcaagaatgctcatattttgctttgttgtgtagctattttttatatattgaggtgccacaaattgatgtgcttatttgactctgttaaaatccaactcaggaggaactcatctccatggttaagaatgtacaatttccaccaaagatagtaccgaggggggaaattcatactacttttcataaatatgctaaaccaaatgattctaaacataaaatagtgtatccaatatagcattgaaataaatctatccagtactggcctatctctacaactttaagcagcttttgctttattatgtaaaagcattccatttttaaatcagctaaacttccaagcaagcaaagacattacaagaaaagattcttcagctacagaacctgtcacatgaggaaccaatttccagggtaagaaaataagctcaaatattttaaaaaaatgtttcttcttacccctagcatactgagctggcagtataatgaatcagaacattttcatttgcatttattctttgacatgggcaaatgacaacctttccaggctttcactgtaggaaaatggcaattttaaaaacttgaataactatcctattaattttatgaagttgttataagagataatatatagtatattatatacaaatatatgtttatatcttatatattaaatatatatatgtatactggaaattacttgtaaatctgtttacccttcaatcttgagactgtacagtactctgataaagaacatattatcatcatcactgattccttatccccagccacttttagcaaattgccttgcacatattaattttttttaagttctgtgatacacatgcaggatgtgcagatttgttacataggtgaacgtgtgtcatggtggtttgccgcacctatcaactcatcacctaggtattaagcccaacatgcattagctatttatcctgatgctctctgccccccaaccccaacaggccccagtgcgtgtcgttcccctccctgtgtccatctgttctcattgttcagtcccacttataagtgagaacatgcagtgtttagttttctgttcctatgttagtctgctgagattgatggcttccagctctatccatgcccctgcaaacgacatgatctctttcctttttaaggctgcgtagtattccatggtgtatacacaccacactttctttatccagtctatcactgatgggcatttgggttgattccatgtctttgctactgtgaataggccttgcatataataattattcaataaatgtttgctacattaaattgaaccatatgcataatcaaagtcagagtctcgctgttaagttgtttaaaggactagatttattcctagagagcaaatagattgttcttaaaaggcactggctatggctgttgaattggttaaaattcagtttggatgcaagtgacagaaaacacagattgtaatatcttaaagaaagtataagctaatttttctgtagcaaagaagtttatgtaggcaggtcaggtatggtgaccctgtaatcatcagggaccattgttgttctaccgtcataaactctcagcttgtatctcctggccaagatgattgcattctggcctgcaagaaaaacaaaagaaaaacaagaaaggtgcatgccctttttttaagagcgctttctgaatattacatcccagctgtttgcatcccattggctggaatatattatcttgccatgcctagcagtgtaggagcctgggagctataatctttattctgatggccatgttcctagataaatggttagtgccattactacagaaaaagagggaaaaaataccaaggacagaaaggtttatcacagtttcataaattgacagtgagctttgagtcaaatcaatacagagcaagtaaattaatttgtttctgataaactttcagggcaagaccatcacatgtgttttaaggatgtagataattctagttaatgaggagagttagaacctatttccaacagataaacttcttttgttggaatccattcaaattcccatccctaatgatctatactaaaacttaatactaagccacaccacatcgattaaaagaaatattatgaaaagaatgcataattgcctgagactaagatatcaggtgaaaggagagagctggttgtaataatcttttcacacaaaaccaagtgaatggtaacttttttggttataatcaaatacatctctcttcttaccctcagaatagagggaatgctgtatagtcactaatgctgtccaaacttaagtgcattgggaataaaaggatggggagactaaacaaagccaaagaaataaaataataataataaaataattctgagagcatctgggatattccttaaagaatttataagattcttcaggagatatgggtagcttgccccatccgaaaactccaaaaacagttatttcataggtctaaaacaactaaaactgaatttattttcactgtactattatcttagtatttttcttaattacgcttcatcactatcatcacccaaaagggtcaattattgaggtttcattcaaactaaaaccctgaaaactaaggatggaaagataagaataagcaaaagataagagaaacattcaaatggaaagaagataaaagaaaaataaattagaagaaaaagaaaatactagatagtgactcagagaagtagaggctgaatttggaggaaaataggagaagtaagaaagtaaaggagagagagatgaaggcaagagcaaaaacactagtgacagaaggagttacacacaaagaaaacaaaaggcaaagaggatattttagcagggagatagaaatcctcttacaggatgggactgccagggaaatctctgaaacgggaggcaccatctaggcagcattattcagtaggagaaactgttcaaatttaaccatcgtttggaggacatcaagccctatttttgtgtgatcctgattttccacattaaaacacagaagctcatggagatattccaccccatttacacaatcacgaaatcgtagaaatggtttggtttcttctgtcattgaatttgatccttacaacaccatcgtgaagcagaaattattatccctacttcccatggaggctcagagagagaaactgacttgtccaagattatcttgaacaatgtgagtcccaggtctgcaacttactcggtgtgttgtggaaaagtcacttagcctccataaaaatcatctgtaaagtgaaaataattaataacaagtccacaggttttcacatataaatgggaatatatatacgtacatgtaaaaatacttggtaaaatgaaaaacataatttgtcatatttactaaaactaaaatgttcagtgtaaaaggctacagggagttacatgctgctagtcctttaaactattaggattgaaaatgatggaaaaggagaaggagaagaaggaaaaggaaggaagaaaggaagtaaaaaggaaggaaggagagagggaaagagagaaagagaggaagacaaggaaacagaccaacccagtaacaacggctaacactgtgcattattgtgtgccaggccctgtactaagtctttgctcatttaatcaccatagcaactctaagacgcaggtactattattaccccagtttgcagacagggaacgtgagccttgaagaggtttagtaacttgaccaatttatacagctggttagcgagagagcctggattcaaatccacacaggtacaagtagacactcttcaactcttttttttttttttttttttttttgagacagggtctcactgtcacccaggctggagtgcagtggtgcaatctcagctcactgcaacctctgccaccctggttcaagcagttcttctgcttcaccctccggagtggctgaaattacaggcccgtaccaccacacctgtctaattttgtatttttagtaaagatggggtttcaccatgttggccaggctggtctcaaactcctgacctcaagaaatctgtccacctcagccttccaaagtgctgggattacaggcatgaaccaccacacctggtctctggtactcttcaagtcttatactgcctggatattagtcagctagaaataacagtcctatgagaaagagcgaatatcataaaaatctcactataaaggcaggaataggaaaatattaggcccatcagcacaccagcagctaaaaatattacccccaggcagagatttagcacgtgctattttaacgtccagtggaatgaaggagatctcagtaaatgaaagtaacatcagtcactctaataaggtcaaatggtgctacaagaagagaaaaaacctccatgagattatttcaattgctaatgaaattacaaattagcctttggagctcagttcatctttcctcagcggatagtgagctaataagtaaatgtaaaaagcaattacaaaatttacacagactttaaaaacctccccatgatcaaaaagctagctcagaagtttcaacaaaaacaacagagttttggttagacagaaatcttagtggttgtatagtccataggccaaagcccttcctaaagtgcggacaatccgacctgccttttaaagctgatagattgtccgaagaatatatataaatgccagtgagcacttgaaaagatgctccatcattagggaaatgtgaatcaaaatcacaatgagataccacttcacacccattaggatgactattaccaaagaaatggaaaataacaagtgttggtgagcatgtggagaaattggaacctctgtgtcctgctggtggagatgtcaaatggtgcagccactagagaacacggtatggcagttcctcaaaaaattaaaagtataggccaggtgcggtggctcacacctggaatctcagcactttcggaggcagaggcaggaggatgacgaggtcaggagatcgagaccatcctggctaacacggtgaaaccccgtctctactaaaaatacaaaaaattagtcaggcatggtggtgcgcacctgtagccccagctactcgggaggctgaggcaggagaatggcgtgaacccgggaggtggagcttgcagtgagctgagattgcaccactgcactccagcctgggcgacagagcgagactgtgtctcaaaaaaaaaaaaaaaattaaaagtacaattaccaggtgatccagcaatcccacttttgggtgtataccaaaagaactgacagcagagactccacacagatatttgtatatccatgttcactgcactattatatacaatagtcaaaggtagcagtaacccaactgcccattgttaaatgaatgaataaacaaaatgcagtaaatacattcaaaggaatattattcagcctttaaaaaggagaaaattctggcacatgttacaacatggatgaaccttgaggacgttatgctatggaaataagccagtcacatataatacaagtgaaataagccagtcaaaaaagaataaatactacatgtttctgcttatatgaggtacctagagcagtttatttcatagggacagaaagtcaaatggtgattgcaatgggactggtaggggaatgggaaattattgtccaacaggtgcggagtttcagattgggaagattaagttctagagatggatggtgataatggtcgcacaacaatgtgaagtgtacttactgtcattaaactgtgcacttaaatatagctaaaatggtacattttatgatatatatttttaccacaatagaaaaacaaaaaaaagaaaaagtaaagaagacttctttgtgtaaatatgaaaagaaattaaagcacgttgagtaagaggtgtcccttacctaaggatccaagacaaataacagagtaattttatttacctttttatatacctttatcttctttaaaagtgccttatgtacaaactaaaaaaatttatatcctaaatgatatacgggatttgcttcaaaataatcaactggggcatagaggaagtggggaagtagaaatgaaacaagatttacctgtggtgaatcattgttgacactatgtgatgtgtgcatgaaggttctttatattatttcctccactcttgtattcgtttgaactatgccacaatgaaaaattgtaaatgttgctttatatttaccatatacaacagttttaaacaaaatatcaagccactgaagagcagtgaattctaaaataaggtaaagaaaatttttaaaagaaaatattccttagatgtcatcacttccattggtaggaaaatccatgtcccttttctggacaattacaatgaacagttcacatacactgaagaactgttatttatacaagctttacatgcactgttcacataatactaacaatataccactttacagatgtggaaattcagactcacagaggtaaagtaactggattcacgttaagtgcattttaacccagacagtctggctacaagcccttcagcttaacaagtacatttcttgaattacgagggtatttttttcttctttcctgctagccaatttagacagcctcaacaatcctgagttgccagaattagaaaagcctgattgagaacctatgaaaagaggtattttgttttttaagggatatgatcaatacctttgcctcatctgtcacagtaaatccctgaggagtttcaacattagcttaggtcaatttagttcatttactgagcacctactaagtgtcagaggctgttaaaccttgggcactgtgctaggcactcagattcgcagaggaatataaattattcgattatgaagacagatgcatgcgaatgctcattgcagcactgttcacaataacaaagacatggaattaacataaatgcccattaataacagactggataaagaaaaatgtggtacatacacatcatggaatgctatgcagccacaacaaagaacaagatcatgtcttttgtgggaacatggaagtagctggaggccatgatcctcagcacactaatgcagcaacagaaaaccaaacactgcatgttcttacttataagtaggagctaaatgatgagaacacatggacacatagaagggaacaacacacattgaggcctatcggagggtggaggatgggagagaggagaggatcaggaaaaataactattgggttataactatgcttaatacccgagtgaagaaataatctgtacaacaaacccccatgatatgggtttacctatatatcaaacctgcacatgtaccccagaacctaaaataaaagtttaaaaaggtagtcagtgaactacgacatgatactgtattgaaaactaaaatgtaatcatgaaggtggaatactagaattccctgagaagagtttttataaaggtaaaaaccaacatattaacatgattgtatatttatctggaaataactacatttctcaacgcctatttttctattataaaagtgagtaaaatgaatattgctcctacttaaaagatacattgaattagagactattgcaatataaactgcaaggcctggtatggcatcttggagaagaaaaaatcacaaattccaatttccaaatcaaagaagcaacaaatcacaataaaaaatttaatacttaaggccaggcgcacctgtaatcccagcactttgggaggccgaggtgggtggatcacaaggccaggagattgagaccatcctggccaacacggtgaaaccccacctctactaaaatacaaaaaataagccaggcatggtggtgcgcgcctgtaaccccagctactcgggaggctgaggcaggagaatcacttgacccaggaggcagagattgcagtgagccgagatcacgccactgcactccagtctggtgatggagcgagagtccgtctcaaaaataaaataaaataaatacttaaatgtttctatttttcaacttgcagagtttcaatacaaatgtaaaacatacttaaaataggtgtttctattacattatttgctatcagagagcaataaaaataaaatttgataaaaaaaactgtcaacagaaaatagaggttaacatagtatttattttagaaaccagaaaaccaaaaataaataatttatatcagtcagttcttcctctttcatggtattaatcatcctatgatgaggtgcttggcatctgtgtttgccatggtaaataagctccgcgatggttcagacctatctgcactgtccaaaactctatcttcagcacttaccatacacatagctgccccatacacagccaaggccaatgcatatgtaatgaatggacttgaattcgaatgtcctgtccattcactcatttatctagagagcaacacagtaaagaggcaagagtagggactttggaccaggcattcattcactattttattcattcattcatgcatctatgcaaccaatattcgaggacacctattttgtgccattgttctaggtcctgagacactgcagtgaaaaacaggtgtttccagcctcacagagctcgacagttctgccactagtcttgggaggtcactcagtctgcgtaagttgcctttcagctttttatttttagaaaaatagaatactaataaccaatatggaagattattttaaagaaaacaagtcatatacataatggacctggcacacagtaagtaaacactcaataattaacaatcaaccaaaagcctaaaaacaaaataccaaatataaaatttagaaccagtgacaaatgacattgatttccagagcgaatgcacctagaaaagttcaaagagaaaaaacattgtaataatattaattatgtgttaatagccatattagtatgaatctattctctctacatggtaccaaattttcttcaaaatcccttggcatacaccatcttaagcattaacaatgaaaaaatgtccacagatttctgtactagaggaaaaaatttctatgaaaccagtttggctgacatggagagctttgtgtggacaatgaaggtcatgtagatttgtattgttcttgacatcttctaccaatgagtaaatggaggaaatcatgtcaactgggcttctaaatgatctacagccttggggacacacagcaagcagaggaagacttggtcaggaagtgttttgcaaagatggcttttgcaaggacactaagggaagttgagacacttgcccaagcttgcatagctactcaggggtggggtgagaattcacatccagctcttctgactcgcggtcctttgacccttcatgactactactctgcatgggctatcaccctcctttaaaagttcagagacttagacaagagaagagagattataaaaaatagattccttttataccttttatacctcaatttaaaattctcagaaagggttctaaacactttaaatcccttttacccagaagcttctggtttttgctcagtcttgttaggaattggagtggctgtgatacatctctgagatgctatgaaatagagatgaattgaaatactttcaacatcagcaaatcatctgaggccccataaacaccctgcacagtacattcatggtacatgcaggcctttgtcttactgaaagacaacctatgtcatctgatgttaggagagtcactcacttcagaccactgaaagtttcaaaaaaagagaaaaaaagtcataaaccaagtaaataatcagtgtcatttaccattatatctaccattcccttacgaggccatggtctatggtcttcctttaaaagttctgttgtattctcttgaaaaaaaaataatttgttgaactctactttgttttaagcactgtatgcaactgtttaagtatagcatattgttttatctcttgtcttggacttgatgctatttgttcaaagtcctttacttcctgccactgtgctgtccaatccaatggacactagccaccaagaccatttaaagttaaatttgaattaattaaaattaattacaatttaaaatccaggtcctcaataacactcaccacatttcaggtgttcagttacctcacgtggctagtggctactatatcaggcagtgagcatatagaacatttcggtcatgatagaaagttctattggacagcatcgccatagagcatcaaatccaggacttccagctaagatcagatatgaacagaacgaccaccagaataggtcagactaagttcccaatcttatcgttcctggggttccaagagctaaactacaggtcagagaaaaaaaagcatctaatctatttagaggggttgactagatatcctggtataatccacgatgcccatgaagcaaccaggatgctgattattcactgacactaaattacaaacacaaagtcttagtggatttattgacagagaaagaaagagaggccatagaaagacaaataaataaagacctgaattcaagctgcgtgacttcaggcaaattgtgttacttctctgatcctaaatttcataatctgcaaaatgaaaaagtagattaactctgagtttcctttcacctctgaaattcctggattctaaggctttatatagtttgcataatacccaaggaactgtgcagactgccaagatatataagacaagatgccaaagactttcccattaatgagtagaggaagctgtctagatagggctaaacaatgtaagacgggacattttaagtatcataaaaatggtattaccaatgcatcctacagaagcctcctctttatcttaccagaaaaatatgactggaggtagtggaaacattcacttttctttcattatcaaaaaatatggtaacatagggtaccccacctggcatatatcgggtgtttaataatttttgttgaagaatagtaataagataaaatgataataatattaattatactagcaggcatgtattggaaacctaatatatactaggttctatgcaagacattttccccaggctatcccattctagcatcaaacagctctatgaagaaaacattaaaacattttttatttttttatcactttatagattaaaaaactgcagtgaaagaagttaggtcaccaaaccacagccacacaactaaacagtggcagagctgagatttaaaaccaagacttcccaattctagtgcacatgcttcctccatttccacccattgtctccttaagaaaacttttacttgtcaatcaccagaaaggaccaaagaagactctcaaactttttaggaacccagctaatttcacaaaactgccatttcctatatatttttccagacgacaaaacaacaatgtatctttccagataggccactcagccaaaatattttctagtctagaccaggtggcaatttcagtggagctggaattgagttcatgattgcctgttagtgttccaatgtcctgagacttttgttaattagacacaagacaaagggcattaaaaagaagccaagttaaatttgcatggctgtgggcaaatggcagaaagaagtgggcctttgtttcctacggaactgggcacccactctatcatctacaattattttataattgggttgatattttgtaggatagaagcctgagtaaccctgacatccatatgcctccttatcactgtcatgaagtggaaagcaagggccaattatttgtgttgctcgttttccacaatcttgttttcaaagagacttaacattaaagtcactaaactgtccaaattcaaagtatttccacattctctgcagtgatcacattctgtcacccacacttcctaaaaataccctgctttccatcactcactagaaccacagaggctattagaaggtaataaaatccctcgagggcttctcttttgcacatttgcactttcctctgatcaattagattcagggagattggaagtgggaaataaaagaaataaaattcaggccacaaatccttctcataatcccacaagtagcactgacaaacaacaactggcaaggaaagagctcaaccctggaagactctcctgctctaaactcaattattatccaaaattcatcattaaatgattactcataaaatccttctatctacttctcatcaagaaatatcatcatggaaatatcaatgatggtcctatcttatctcagggtacatgtcagtattagtatcactgagataaaaacagatctgaatatgtttagggtagacaacatcctttggtccagaaagtttctttcaaataatctgatttacaaaagacactccatttaaaaatttttcagaaatggcaagatccttctctcagtgcctgcctcccatctgagcccttaatttagaaatctgagggcttaaaaggaccatgcctttcataatgatcttttacaaacattccttccttttctagtgcgtctttgtcttgttgtcccttgtatatattcctcactctgctaacatgtagtaaacccagacggattaagaaaactaaggttcaaaaatgttaaagatcaactgggcacggtggtgcatacctatactcccagctactcagaaggctaaagcaggaggttcacttgagcccaagagttcaagaccagtctggccaatacaatgagaccccatctcaaaaaaaaaaaaaaaaaaaaaaaaaagccaaagattatttttcacgacggggatttcggcgagaaacatcgacaccctcagcgttgaccagatgggcagtcctgcactgacaaacccactgagttaatgtagaatatgtcagctagctcaatgctaagagaccagtaatatctgtggcccagtctcttccagagaagaaatcaagccactcctctctctggcaagtatgtctcctctcataaaacaggctgacttcagaagtagctttcaaagacaatgcttagatcaagccaatcagcgtaagtactcttcctggttgggtgatagctctcactgtgacttcatataagaaaagccagtggtcttgtcttgctcttcaagaatggagcagtcacggctgggcactgtggctcacccctgtaatctcagcagtatgggaggctgaggcggaaggatggcttgagcctaggaattcaagaccaccctgggcaacatagtgagaccccatctctagaaaaaacaaaaaaattatacaggcatcatggcacccacctgtagtcccagctacttgggaggctgaggtgggaggatagcttgagcctaggagttcaaggttaaagtgagctatgattgcaccactgcactccagcctggtcaacagagcaataccctgactttatttaaaaaaaaaaaaaatagaatggagcaatcttaaccctaaaataacaaccttttgccagtaccaccatatgataccatatgtgaaagatttattcaggtacctgagcttcacaagtaacaaggctggcatctattctcttctccaaaaggcattgtttcctcctttacaactaaataaacagtgcaaattatgtcctcaactttaagtcaggtttgaaaagaaaaaataaaaacaaacgaatgcaaagcaagagactatataaggatgaagggacagcacaggagaatggaggagagaatgggcataggagaaaggtgaggggaagggggagaggggtgaggaacagtgaacttggtaagtctgctatttccaaaaccatgtttactgcagtaagataatgaatgaggaaaacattttcattttcttttctgacagcttgagcataaatgatagctgcaataatatcagaaattattgggcattttgaggagtcttgctagtgagaagccagcattccagccaatttgaagctctggccccaaggtgacctagaaattttgtttttcaaatgcaggaatgtcagctgctggactgaaagtgatgtatactgtctagtggacagcatgctggccagacaccaaatttggagtgtctctccctgtactcagttgttctttacggccagtgctgcccccacaaaggagagttttgtctaaagccgaccaaaaacgggggtagtgtttaagatccatcaacaccaaataacactgagttttgacttgtcacctctacagattcttcaagaagctgatctgaatccaacacctcttggagttagttgggtctcttcttcctaaggcagttgattactactagttctaatctagttaggggcctgactgaaggaggcctaaaaagtgccaggaataaaagcagtcaagcctcataattttatgtgtttttaaacaagacaccctcaagtacataaaacaccacagccattgtaatttaatcatctgcttatgaaaaagacagcactctaaacagaagaactgataaggcaaataatttgcctataaggatttttaaaatgtgtctctgacatcaaatgaactctactgagattccctgtattatgccaaaaacctactggccaacatccaagactgacttgcaagtaccaaccctaatccggatcatgaagcaacattaccatcacctgtacccttcaatagggtgatatccactctaccttaacaatcagagttttatccgctgtacattttttccataagattcctatggacttctccatggaaaacagatccctggaatctttctgtgatttggaggaactcctgtaatttgtatgaggatagtgataacgagagaaacatcaaacacacacaagaaatttacacatcccagcttttctgtgtattccactttggaaaccaatagcctatgaagataaaatggaaacagcacatacatatcttgagtgtgtgtaaatcatcagagtcatatgcaataagtaaacaggaggtgtcatgaggagggaaaacaccacgaatattcccagttcagaacacactttcaagaacgatgcttcaatagtgaagtagaaggggaaatgggcatgagtcaatagaacagcaatttctctatcctttctctccactgttactaagcaatgtcctattggaactgaactttttttctaagtcttcgattgacttcctaattaataagcattgtaatctagtgtttattcctttatgaaggcagagcagttgaaatatcctaacacacatattcaaccaacacccctctccaattattgtgttgttcttcacattgaaatttggcctctactgagaagatattgaatggaaagcccatataagatagaaaaaatagaagcataatggacacacgaaatatgtgatgtcacgatctatgtctacacacagataaagaccatttgacctgataactagcaaatgataagcaaggacgctgtgtctctttatacattatctgatattatttatatattgttatttctatcacaaagaaaaacaaaaaacatatgctcagagaatacaagaatagacagacaatccataggtaagcattaagagtaaaatgtactgaaaggagttactttttccaataatgccttatcaagaaaatctttctttgacaagtaagttatatgtggtcactaataataagcaaaaagctaataaaagaagggaaaaatgagtagcacaagcagttcccagcttaatcaacaaaataatcatgctttaaaaaatgaggtagtacattctcttcctgaaatcattacagtctgttaacttaaaagtaaaattaatggcgattcgatgctatacaacactgtgtagagtaaacccaaaattaccaatatgaggctcaggtacactaaacagtcaaataactatttctgaaagccctgtcttcttattttttctttttttgttctcataataactgactgaatgacacacactagttgctgcatatttagtttatttctaatgaagataactattaggtgtccaatctactcagtccttaatcttttaaagggaaacagagagggaatacaattgtttagcctaacggaaatagcttactactataattttccaaccaaaagtctaactcttcacattgtatacacccataagatagaattcaaaattctcacagcttgcatattacaatactcagagtcttaccaaacacaaaatattatgacttatttgaaaccaccgaactccccccaaaatatttcttctcaaaaccaactctaaatagaatagacaggtatccagttatttcaattaacttaaaaatacaatactaataatttaaactcaagtagattattttcctgatttatgcagttggaatgctttaagactaacatagaaagctaagttctgatttatctttcccatcatactgttttatctcagacacatataaatgcattcataggtacacagtatagtactgttcgcccaggctagagaataaaacagctagcattgtaccaggacgcctgtgcatctttccattaaagccatagcaatattccctcaaacacatattcatcactaccttttaatgattctgggctacacggatgaaaagttttgatttagtgcaggttaaagtagcacatagtctttcatctttattcataatcagctctgatccccttgctgaaaaagaaagaaatgcaaacatcttgaactcttcaatgggcttttctctaattaaagcctttaacaattttggggtgtttcaaagcatgacttcctttttaccattgttagtgttaactaaagaaatattgcccaataagcactccagataatatactcaaaaaatcatctataaaatgcaataaaaatgattggggcagaagaacactgcatccttaattttagtaagattgttgatgataaccagagtgaagctgcctaagcaatcactcaaaagcacatgtaatagttaaacgcatctttattatggttgctcagtgtctaaaagtttgttgccagtagcattgctattaaatgtataaggctgtcaaatctatttgtggccaaaaaaaagcaactctgcaagataaatattatttaatgatttaataggcatacggcactagaatataaatacccataaataccccaagtcataaaagtaacagaaagtaaaaaataatttaggctaagacaaaaaaagactagaattgtttagtcaagaacgaaattagtaaaccacatacatttacacagacacagtctctcttgccacaaaattgcaaagtggtctacttttatttctaaaatgtgatatgcttatatcattattataacctaaatgtttaaagggggtataagaaaaagcttctaaaattattacggatgctactaaatcatgtgtataacaaccaaaatatctggaatgcccaaacgtgctgtcattgctcaggacagaataatctattcaaaaccagcagggaacacgtgaggaggcctcatttacttcagtgtgtttccccacatatgcatcatttgagaatgtcagatcactttcacgtatatagtacataatcactgatgatctgggaaatccacaaggccacaaagttgatacatactctgatctagagggggaaaaaaatcgagaaagccggaagtttcccgttttccaagaaactgaagacattcttacctttctgtacaccagcatgttgggtgattcatcggccaccccgttgctggtctgcccataattattcccctgggccatgtcacccaaaacttggtccactctcaagatacaagaattatcagtgtgccctgcaaagggtcagagagacttcagtgagatcccagtgggactcccctgattcatcatcatcattcacagcacccaccccacatggcgcgttcttacaaactggggctggctggagaaagtgacacaggacatggattttttaaaaagtgagttgacacctacaataacctcaaggaattgtaagaaattacaatcttccaggtagaaatagccatttggttattgttttagctgacttcattttctggatactcattttgagaagtgtttgatgctcaccctaaaaactcgtgggtagcattttcctagtacagagttctcttctctcccaatacttgcatctgaacttggtgatgttttccccaaagggtggaaaggcaacacctgggggatgcggtgggggagtggggggcgggttagcacactttctcctaggtatctgtctagtgtccccacctgcagcccatcagagaggcccattcccggtgtcattctccagcgcacgggcttcctctctattcccccgggtctcccacacagagccggagtatatgcttcgcctactttcacctgcctgcgctgccagccaccggctgctctcctttctccccacttcgcttcggaagtccggaggtaatcctgcctaatttttgcaagaagacaccagaatatgtcccggcaacaagaactagtgggaggtcaagccttcaggccattttacccgggtcaccgtgggtaaaagcctaactgcagaagcctccagagcaaccagccaaagaggagaaaacaggcaagcccctgctccccttgctcgctctcacggcagcagcaaatggcaggcgagcctgtgccccgcgccgcggcggccgccggagccgggcagcagtttcagcaccgtggaccgcggggtgcgcgcggcgcccgtagcccagccccggcgcggggctcccgggggcggccgccctgcgcccgcggacgctcccgctgcgcagagcgagggctgggtgcgggccgggggccgggagggctctgggtggcgctgcctcctccccgcccgccttccctatttacctcctccgccaaggtcacggccccgcggcgtctcccctcccgggcgggctgggtgcaggcggtgtcagctggcggcaagcggagcagcgaggcagggtagcttcatcacactcgcggcggatgcggattccgcgccgccccggctctagctgctcaggcgaccgccaccctcgcctcgccgccgcccgtgcacaggcggctccggcagccgccactcgcgcccgctcccctgggccgcctcgctggctctctccctcctccgcttcttctcccggggact

SEQ ID NO: 2446 - DNA, 76 bp, Homo sapiens
catggatttgattgaatgattctcccatttccacatggagagtggagcccagagaattgtttaatcatgtatccat

SEQ ID NO: 2447 - DNA, 102652 bp, Homo sapiens
gtttggaaaaatgactcagtaagttcagcgcgcccgctccggccggccctgcgcctcccgccgcgcccgggatgtattcgtccccgctctgcctcacccaggtacggtcctcgcccggccccccgccggcgcccccgcgccccccgcatcccagccccggagttttgaagcaggaggaggcgggacgaaaaaggcgcgcgtccctcccgccatccctgcccgggatgccccccgcgccgagggctggggtccggtggggggatgggtcaggctggggtaccccccccacacccttacctaccgcggaccccctacgcgggactcccgcccagcacccccaaccccgactctcgggacctctcccggatgtggggcttggtctgcagatttgcgtcccccccccacacaccgacgcactccgcacccccgccccgacactcggaaaggtcggggtgggggctggcccccctccagcaagggctctgcgggaagccccccgcctgcctctgagaggaatctagggggtcgtgattggaccctgggtctccccagctggagagaaagggacctctcatgtgttttccccgtgtccccccaccaaggttgtgcgggccgccctggccctcggtcgcctttccctcgttattggcccacgtgtgcatggagggggagggggcaggagaagttggaggcccaggagggggaagggtgctccggcggcccggctgggtcccccctcctttgcaagccccccagcaccgtcccggtattttcgctgcatcgattctggattctggattctggattctggagccgccgccgggaggagcgggaggcccggcgctccgggtctggcccgggcactgcggcgctgcggacgccctcgccagcccggcacctgccccgtcccctccccctccccctccccctcccgtagcctctcacccctggccgcactcccagactgccccggggccgagccttgtgcaatggccgagggggtgtgtggggagggggcggctccccccggggactccttccagcccaggctcccggggaccccgaggtctgcaagttccgttttctagaccgctgctttcctccttacgcagtgtgtctttaggctggagaggttctggcctcagtttcccctgaagtgaggtgcggctaaggccggttctggagaggggacagtatggcgggcaaactgtaaagtcccggcacgtggggggtgcgattccagcgagggccaggcccgtcttaagaagcactgtgtggggagtatatgagtccccggcttccgctccagggcatggtgcagtgagggaccccccacgccaggcatgctccttggtagggtctttctcaccggccccctgcagccgacagggaatgtgggagctggtgctgagggggtctgaggtctgtcctacctgtgatcccctgagtgaccttgggtaagtccctgtcccagcctcagtttccctttctgagcagctttggggggggggttcccgaagaaggcatctctttgaagttctccaagaacaactagggttcgagtgggcacgctgtgtgacctcgggcagcctttgaagtctctgggcttgtggggtgactgaggtgtccccgctctgtcctcaccagctggaaggagccatttgggagggctgagcggaggggaggctgttccaggctggggaggttggaaggctgcctgtgcaccctggaattcccccatcagggctggttgggagacatcctggttgctggggtgggttgggggttagtaagaaccccagtccaggctttgcctcagagaattgctaactcggcctcagtttctccaggaacagggcaaggaccagccaggagggctgtctgtggaaaccaaaaaacggagaggctaaaaactaaaaactatccaggggtgctgcgtgcaagagacagagatgagaagacagagacaggcagagagacagaggcagagagctcccaggccagagtggggacagcgagtcccaagtgcagggggctccctcctcccctgcgattctcctctctgccccgccctccaccccagccctgtagtggagctggggaccccctttccagtttgtcttcagcctgaatgtaatccccactgttcccccaaggcccagcctggtctggggtagccagtggggtgggctgggggactcagaaggaccctgagtgccccatgcaggagcctcccacccaagtcctggctgcctgactcagtttcccgaatcacgtcccctccgtttctctcatcttggtctctttttgtctgtctttctctctttctctctgtcttgctctgactctgtgtgtgtgtgtgtgtgtgtgtgtgtgtgtgtgtctgtttctccctgtctctccatctctgtctctccccgcctctgtttcactcccagtcactgttggtctctttgtgtctctctttctcatcctctgtctctctgatgtctcagtctctcccactgtctctgtctcttcatgtctatctcaccatccctttctcctctttgtctctgcatgtctctttgatgtgtctctgtctctctgtctctccctccctttgccttctttgtgtgtctgtccgatgtgtctctgtctgtttctctgtctctgtctctctgcccccttcctctctgtctctgtttctctccaatatgtctgtctgtctcttcatctctgtctcaccttccctttctcctctgtctctgcgtgtctccccttgccccctctctccctgtctctctctatctctgcatgtgtctccttactcctctctctctgtctctctctgtctctgggcctccctctcccccttttcccagctaattttacaacctgagcccaaccgaaaatagctcccttttagctgatccgacccggatccttctcgggagccgaggctggcggggggtggggggcatctcggtgccagcccgctctgtgccacccgggcccggcccgccgagtggggagtgggtgctggcggccctggggcattctgggagccccgggccgggctcagcggtgactcaagcgctttttcacttttactcttaagaggaactgtgtggagcccatggctcccataaatcctgccggcgggaaggccggcctccccgcgcctgctctgggcctccctccctgcctccctcccgctggcgccaccgccacgttagttattccgggtttggggccaagtccctcttggccgcagcgtggcggattccccgagccacctccatcccgccaccgggtccctgtctcattcgttcgttgtttccttcattcgttcgtcccatgccctctcggagcacaatgtgctttgctgccatttctccagcagggtaaccgaggctgggagaggctgtcctcccaccccagacccccgacctttgttggattttctagatcttccttaagcatctcctgggccctggggataggtgggggtgggggaggcagcagggcccaggcccagtgtaggttcttagagggagcttggggggtgcctaccaggagcagggggcctgcagcccctcagtgccgggagaggggctaagagtcagagagggccagggcctgcccgaggtggcacagtggggctggcagagctggggttcaggccattttccatctggcggcttgggcaggtgggcgctctctccccgtgtgccccccacccggggcctggtggcctctgattcactctctacaaggctccaccactctcccgctgtatctccctctgggtctctctgtgcatctctctctgtttctccccctcccctctctgcggcggaggtgcctctgcgcgccagggccaagcgccctgtaaatcaccaaagctgggattctggcagagtcagcgttctcctctctctctctctctctctctgtctccctccctttctccccccatctcgctctctcctcctctctccctctctccttctctgtctccctttccgtctttccctcttcctttctctctctctccccgtctcccttctctccctctctccttctctcttctctctctctttctccctccctacctccctctctgttcctcttctttctctctgtctgtctctttctttctccctcccttcctctctctctgttcctcctcttctttctctctctctgtctctctgagctggcctccctccctgtctcacaccaaatggatgggaaatgctgcctgggcctcctgccccggacacggcccgccccccactctcctgcctgtgtccacgccgacctcacctgggtgcccatctgccctgagcacacagcgtgcgggcacccaagtcctgaccagttcacatccatgagcacacgctgggcgcacacgcgtgcacactccctgacacccatacggacgaggacacagctctgcctgcctcggatctgccttgatgggggtcaccaacacacagacctagagtgcccctcacatctgcctgaaaatcttgctcaggaggtgccaaacccaatatagtacctggtatagagaaggtgccaaataactgctatagagtggtgccaaataagtgttgctgtgcttgtgattgttgctaaactaattctcctctttcctgactctggtgggtgacctgcccccacccccggaccgtttcttgccctgaaatgaagtcagcagaaacccccacttcctcagggctgctgcagattcagggaggcagcacaatttttttttttttttttttttgaggtagagtctcgctctgtcgcccaggctggagtgcagcggtgcgatcttggctcactgcagcctccggggaggcaggacatttctgaggtccacagtgcagggcttggtactcagtaggtgcccaataaatacctgttgcacgaatgaatgaatgaatgaatgaatgaatgaatgtttttggttgagaggcgggactttggtcttcccgagcctccatttctccgccaacataaaataaaaaacataatggcactttcctcagagacatcgatgtaccttagtccgacacctggtatacagtaggtgccaaataagtgctgctgtgcttatggttgttgctaaactagtaattgcattgaacaccccagaggcattttccagtttccctcccttccctctgtgtgtatttgcgcagcgtaagcccagctttgggctgggtgacaaggacagtggtgacctggaaaggcccaggctcagacccctctctactgtggcatttctgttagtttttcttttctttcttttttctttctctctccttccttccttccttccttccttccttccttccttccttccttccttccttccttccctccctccctccctccttccttctttccttctctttctctctctctccctctctctccctctctctctctctctctctctctctctctctctctctctctctcggagtcttgcactgtcgcccaggctggagtgcagtggcgtgatctcagctcactgcaacctccgcctcctgggttcacgcgattctcctacctcagcctcccaagtagctggaattacaggcacgtgccaccacgcctggctaacttttgtatttttagtagagacggggtttcaccatgttggccaggctggtctcaaactcctgacctcaggtgatccacctgcctcggcctcccaaagtgctgggattacaggcatgagccaccgtgcccggcctctgttagtcttttctccctgcccagccctgtccagggtctccctgagtttgaccagccctgtgtgggtaccagccttccttacacatgggggtgcatggataaggggggtcccagaggcagaagatgggagcattgcttcagtggtctggatgctggagatgctaacagatcaaagctgtgcccttgtgggaccgacagtctaggccgggtcggggacgggcaggaaacgaggtgaccaggactccttgaggatgtggtgtgcgaccgacctcggggatcaaacaaggggaagggaaccacgtgggactcggagagtgtgcacggtgcagaccaggtgtcactggacgctctggcccgagactgtttgctcaaggggcccaggagtggggtgggggggtgccaggaggcccagggaccagtcccagctcagttcctccctgactgtgtgactttggtggaagatttcatgcctcagtctcctcctcgaggtagtgggtgcaatgatagtccccactttcatagtagactttttttttttttgaaacagagtctcgctctgtcgcccagactagagtgcagtagcacaatctgggctcactgcaacctccgcctcccgggttcaagcgattttcccgcctcagcttcccaagtagatgggattgcaggtgtgtgtcaccgcacctggctaattttggtgtttttagtagagatggggtttcaccatgttggccaggctggtcttgaactcctgacctcaggtgatccgcccgcctcggcctcccaaagtgctgggattacaggtgtgagccaccgcgcccggcccctatttcgtagtagacgtgatagctcagcaaacgctcagcctgtaagaggcacagcctcgctccctgcctctctcctccacctcctggcccctctggctcagccctcattgtcctcccagaacatcaaggcacagagggaagtaggggacccagggttcattttgctgactcactgccttggcagagagtttgaaccctgtggactcagtttacccaaattcctcactgtggcccacaaggccctgcccagcctgtccttgtcccctcctcaaccctcccctcctctctctttcccccttgctcattctgctccagccacatgggcctcctcgctgttcctctaacacgccaggtgcggtcctgccccagggcctttgcatgacccatttctccatcagaaagctcctggcctggagtgccatctctcaagactttgttcaggtgtctcctcctgcaagagaccttcctggaccccccccccaagctaaaaaacaccccccaccccagagattctctggtccctcaaactcttaaatttcttcagagcactttgcccaacttgacgttttattacatattttgctgattttaaccatccgtccctgccccagatctggatccaggtgagggccgagcccaggtccctgccaagtcctcggcaccctacctgggaccggcatgcagcaggcactcactaaatgtttgctgagcaacagaatgaatcttccctctctgggagccgttcacatgtccacaggctgtgattttctgagccaggggaaggagcggcccaaggttagagcctgacgctggtgccggatgggcctggggttgtccgtgggaccatggacaagtcatccgacccggagaagaaggcattagaactaaggctttgaaggatgcgtaggaatttgggataagtgctaagtaggtaatgagctagattctcatgaaggattgttgagtcacttttacctggaaacttttggtttggaaattggagtttcttgtcctggtttgctggcctggactttcagggtgggaggagcacagggaggtgagtgagggcatcacccagtgcatggcgtggtcgttcagcaaggtcttgggtccagatgtctctcccagctgctgctgctctctttggccaggaagtcccagtgggctaagctggggtttccaggaaagacctagccttgttccccttctccccatcaccttgcaaggaacaaggtcaccaggcaagctcccctgtctccagcaggctgcaatattcctttctgcccattgtacagaatgagagactgaggcttatctgaggtgatctgttccccagccattcagatggtgaaaatagaccttactgtcacccagccaccttctccgacagtgggtgcctcaactctgggcctcaggattggagagggagaggtgatagaactggatggtcctggctagatctgggaaaccctgggttgaggaggaaaggctgcttgaaggaggggacactagagatagggcgttgagggatgtgtaggagtttgggaggattttcagcatctagcttgtcttggttatctcttttgccggttgggcctctgagggcagtaggaggtccctggggaagaggccctggttattgcaggtcatgtgggagaaacagagtgacaaccggccaaccaggccctgcctctcacgtggtctgatcccctggggaggacaagggaggatggggcagcaggtccatgacccagttacaagctgtttgtcttcctgcctctgtaactagccggggtcaccactgacgtgggcccccacccctgcccgcctccctggcacctgtccccggaaagggcacagagaaggggaggaacatagagaagggagggacagttagggaggaggaagggaactcagatctacgaggggccagatgagaaaaggaattaagaggagaggggaagtggggagggggaattcagagagagaggggggttggggagagaaggagttggggggacagtgatccctgcccccatcatggatgcctcccctgtcccttccagcagcctcttatcacagccccagtaagcgccagagcttgggtggcagccacggccccagctggacaacattgtccgggcctcctgcccgcctggcatctcctccacaggcaggtcctgcgcctctatgggtcctctctgccgcgtcccactgtgccccccaccacccccactgcccggcttccctggccagaccatctgggctctggtcccagctctgctgaccggctgtgtgaccctggacaaaccactccccatctctgggtctcatccagtcaggggcagggacgagattggacagggcctgggccgggccccctccacctcccctttgccttagcaggttggctggggaagcgggggcagcggaaaagggccctgaggtccggtccccgccgcagctgttacggtgactcacgctttgggggacattggggtgggggagcttcgctggtacaagctgactctggtctcactgggtggggaggctattttcagagcctcagtaataggtgaaatctgatgtcctgcccctccccccgaagcaccccacggccggaggtggcccaaggggacgtggagcacagagcagggagggtgatctggcagcagctgctctgcccatcccggcctggaaatgggaccgagtccagccacatccgctggcacacacagtgggagtccagggtcaacgtctccctaccttcctgagaccccaatcttacagagaacaggctgttctgagaaagggacccgtggccttccagggggtcagggccctgattcttatcctcacaccggccctgagaccctgtgggacctcagccaggtctccgcccctctctgagccttagtttccatgccacagaacacggagcggggcctcaggctgttccctgcttcctggaagattgtctgcaatcaaaatgatcatcgcagcaatcgcgtccatagtaatgaaaataccccagcatcttagaggggccgaggcgggaggatcgcttgagcccaggaattcgagaccagcctgggcaacatagcaagacccccatctctactaaaagtacaaaaattagctgggcatggtggcgcacctggaatcccagctactcgggaggctgagacatgagaatcgcctgaacccaggaggcggaggttgcagtgagctgagatcatgccaccgccctccagcctgggcaacagtgtgagacactgtctcaaaaaaaaaaaaaaaaaaaaaaaaaaaaaaaggaaagaaaatagaaaatatcccagtgccttaggaggccgaggtgggaggatcacttgagcccaggagtttgagaccggccaaggcaacacagtgagtgagactccatctctgcaaaaataaaaattagccagacatggtggtttgcacctgtagtcccagctactcaggaagctgacgtgggagaatcgcttgagtctgggagttcagggcccaagtgacctaagatcgtgccactgcactccagtgagacgcctgtcttttttatttatttatttatttattttgagacggagtctcgctcttgttgcccaggctggagtgcaatggcgcgaccttggctcactgcaacctctgcctcccgggttcaagtgattctcctgccttagcctcccgagtagctgggattacaggcgcctgtcaccatacctggctaattttttgtgtttttagtagagatggggtttcgccatgttggccaggctgatctcaaactcctgacctcagatgatccacccacctcggcctcccaaagtgctgggattacaggcgtgagccaccacaccaggctgagacccccatctcttaaaaaaaaaagtaataaaaatcacagtagccccagcactttgggaggccgaggcaggcggatcacgaggtcaggacattgagaccatcctggctaacacagtgaacccccgtctctactaaaaaaaaaaatacaaaaaattagttgggcatggtggcgggtgcctgtagtcccagctattcaggaggctgaggcaggagaatggcgtgaacccgggaggtagagtttgcagtgagctgagatcgcatcactgcactctagcctgggtgacagagcgagactctgtctcaaaaaaaaaaaaaaaaaaaaaaaatccaatagcaatataagttgtaatgataacaatcatcgcatcattaataacaatgtagtcctttgagagctggggggaggaaaacagctttctgtgctaggaagggatcacccctgtccgaaatgcccagcccagcctggtcaaggcagggagatggaaaggcagttttgcttctctttctcttcttgttccttgtatttattccaccttgaggctgagaaactaggtcccagatgtttttaatttgttttattttattttttatttttttagagacagggtcttactctatcccccaggctggagtgcagtggcacaatcacagctcactgcagcctcgacctctgaggctcaagtgatcctcccacctcagcctcctaagtagctaggactacaggtgtgcgccacagcaactatgcccaactaattatttttgtaatttttagtagagacggggtttcgacatgttggtcaggctgctctcaaacacttgggctcaagtgatctctccacctcggcctcccaagtagctgggactacagacgcgcaccacaaaaattatgcccagctaatttttgtaattttcgtaaagatagggttttgcctgccggccacagtggctcacacctgtaatcccagcactttgggaggcagaggcaggtggaccacctgaggtcaggagttcaagaccagcctggccaacatggtgaaaccccatctctactaaaaatacaaaaattagctgggcatgatagtgtgtggctgtaatagtgtgtgcctgtaatcccagctactcgggaggctgaggcaggagaatctcttgaacctgggaggcggaggttgcagtgagccgagattgtgccactgcactccagcctgggtgacaagagtgaaactctgtctcaaaaaaaaaaaaaaaaaaaaggagatggggtttcgccatgttgcccaggctgggattgaactgggctcaagtgatccacccacctcagcctcccaaagttctgggattacaggcgttagccatagtccccagctgagatcccaaatgctatgcagactcagtttcccttgctggaaaatgggaagaatgggaggggcctccccacacccagacagggagctgggggcctcccactgccccacatttctcttcaaggggctgctgttattttcgtggggaagtcagatgagtgcaggttccagtccacctctgtcccccatggccgggttccccctcaaggcctcagtttcctcatctgtagcatgggtgttgtgactgccctcagacaccaatttgtcatgatttgggagtaggttgaagtcccagctctggcccagtctcagcgccttcccagccctcggattttccatctccagggtgggtctgcagggaacggggtggcccctctccccagttctgaacctttgtggctgagcgtctgcttctctggtctgtttctgtatcagcacagtgggttcatggaaaggggaaaggagggagaggactccacccgggatttctcctccctctgattaatcctggtgcacttgaatctcttatcttttgatgcagaaatccccccacccttccagcagccctcaacctccaggcgggcctagtgtctgcctgtggatctcagccaggcctgtctgtacatatgctctgtaggaacaagctttcgtagtcattttttgtttttttgttttttgttttcccaagatggagtctcgccctgtcacccaggctggagtacagtggagtgaccttggctcactgcaacctccacctcccaggttcaagcaattctcctgcctcagcctcccaagtagctgggattacagtcatgcgccaccacgcctggctaatttttgtatttttagtagagacagagtttcaccatgttagccaggctggtcttgaactcctgacttcttgatctgcccgcctcggtctcccaaagtgctaggattacaggcatgaaccaccgcgcccagccgggttttttttttttgagacggagtctcactctgtcgcccaggctggaatgtagtggcgagctctcggctcactgcaacctctgcctcctgggttctcctgcctcagcctcctgagtagccgggactacaggcgtgtgccaccatgcccagctaatttttgtatttttagtaaagatggggtttcactatgttggccaggctggtgtcaagctcttgacctcaagcgatccacctgcctcagcctcccaaagtgctgggattacaggcgtgagccactgcgcccagcctcatttttcatttttttttatttctttctttttttttttttttttttttttgagtcaggagtcaggggtctcactacgttgtcacccgggctggagatcaatggcgcaaccttggctcactgcagccttgacctcctgggctcaattgatcttcccacctcagcctcccaagtagttgggactgcaggtatgcatcacctagctaagttttgattttgtagaaacggggcctcgctatgtcatccaggctggtcttgaactcctgggctcaagcagtccacccactgtggcctcccaaagtgctgggattacaggtgtgagccaccatgcttggccgccgaccctagtttttttttgttttgttttgttttttgagatggagtcttgctctgtcgcccaggctggagtgcagtggcgcaatctcggctcactgcaagctccgcctcccgggttcatgccaatctcctgcctcagcctcctgagtagctgggactacaggcgcccgacaccacgcccggctaatttttttgtttttttttcagtagagacggggtttcactgtgttagccaggatggtctcaatctcctgacctcgtgatctgcccgccttggcctcccaaagtgctgggattacaagcgtgagccaccgtgcccagccttgttctttttttttttttttttttttttttgagacagtgtttcactcttggcacccaggctcccaggctggagtgcagtggcacaatctgagctcactgcaacctctgcctcccaggttcaagcgattctcctgtctcagcctcctgagtagctgggattacaggtgtgctccaatatgcctggctacatttttttgtatttttagtagggacggggttttgccatgttggccgggctggtctcaagctcctaacctcaggtgatccacctgcttcggtctcccaaagtgctgggattacaggtgtgagccactgcgcccaggctttttttttttttttttttttttgtgacagtcttgctctgtcgcccaggctggagtgcagtggcaccatcacagctcactgcagcattaaactcctgggctcaaatgatcctcccaccccagcctcccaactagctgggactacagttgcaaaccaccatacctggctaatttttgtttttttgattttgtttgttcatttgttttgtagcgatggggttttaccatatggctcagactggtctcaaacttctgggctcaagcagtcctccctcctcggcctcccgaagcgctgggattacaagtgtgagccattacacccagcccaaccctagctgcaataggcagagaataggtccctgacatctttgttctcccaacctcagttttacccgtctgtacaatgggttgtccatgagcctccacctggcccccttagcttgctccatctgcatgctggggttcaacataggtcctccacggctgggcatggtggctcacacctgtcatcccagcacttggggaggccgagagccgaggcgggcggatcagaggtcaggagatcgagaccatcctggccaacatggtgaaaccccatctttcctaaaaatacaaaaattagctgggcgtggtggtgggcatctgtaatcctagctactcgggaggctgaggcaggagaatcgcttgaacccgggaggtggaggttgcagtgggccgagattgcgccactgcactccagccttagcgttaagagcaagactccgtctcaaaaaaaaaaaaaaaaaaaatgatcctccacaaacttccgccttgatttgtgcctctcacatagtccaagtctgtttgctcatctgggcgatgggttcttgcaggtccctgataaacttctcctgggtcccccgggccttttgcgtgcctccggcggcgtgcacgggtccgcagcgaccccctgcccacctctgcccagcccctcccactctgcgggtctgttcagggcccctccgacctcagccttcggggccgggcagtgggtccgccctctgcgtccctggcgctcctgacctctcgcctctccggcctgcaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgaggtgaggtgtggtggcctgagcggagcggccagcggggagggtgtctgatggtggtgacacggggccaggagggcctgagggaggaggccagtgcgtgtgggtatgatgtggtggtctgagaggggaagtgggccttggagagtgcccaatgggggcgacacggggcacggagcatctgagggaggaggctggtgggtatagatgtgatgtggtggtctgagaggggaggcgagtctaggagaatatgtaaagtaggtgatatggcacaaggagagtctgagagaggaggccagtgcatatagatgtgatgtggtggtccaggcagggcagcaggcctgggagagcatctgatgggggtgacatggtgcaaggagggtctgagggaggaggctggtgcgtgtagatgtgatgtggtggtccaagcggggaggcgggcctgggagagcgtctgacgccgggtgacacggggcaaggagggtctgagggaagaagccagcatgtgtagatgtgatgtggtggtctgaggggggaggcaggcctaggagagcgtctaatgcaagtgatatggtgcaaggagcgtctgagggaggaggccagtgcatgcagggcccagggtggctgctgatgggatgtggaggtcagatggaggaggcaggcctagcagaggtctcaagtgagagatggtacaaggaggtttttttgacagaggaggcaggtgggctgtggcgctccaatggtagaggcaggatctcaccctcacgtctgagggaggaggcaggaaggcccttgaggtctcagggggatgagaatgtcctagatggtcttgggcacaacggacggccttgctgggagcaggggtgaggagaggagagggacaggccatcccagccctccgaggagagccaagagagtcctggcaccgctttctgtgaatgcttgttggttgattgactctcagaccatgccagcagaggcctgatgagcctggccctgccagaggggtgtttgccggtggtcaaatgcctgatgttgagaccagctagctctgtggggttgaggaaatccaaggcggcttcccagaggaggaggtgcagctgagctcagctctgcaggatggccaggccacagtgaacaaggagatgccccaggggtcctggcaggagcgtggagatgagaggcctgatgcctgtgcctctggtcccggtgctaagagcagggttggtcctgcagcttcttggctgcgtggccctcttggacttcagtttctcttgcctgccaaatggtggagatgatcagtctgtagctggatggggctatgggaggttccagaagatcatgcgtgtagccacgtgcgaggtgtcagctgcatcccaagacctgagtgggtgcacagcacacccctgccatgcccatccaggccgtgtctggagcacgcgtgaacccccacacacccaggggctgccagagcatgtgggatgggtgtacgccagacgcagacccacacaggtcaccagcccagccccagcccaggcagcactctatagaaacaggcagttgcacagcctgagagggaggggcatttgcccgaacaggaggaccctggggccagactgcccatgctccagacacagcccttcttttccccagctgtatggacacatcccttttctgtgcctcagtttcctccttggtgcaatgggagtaacagccatgccaccttctagagctggtgcaagggtgagacagggtcacgggctcccaggctctagggtgtgtggaaagacagcagggcagagttacccagtgtttttttttttttttttttcctggagacagggtctcgctctgtcacccacgctggagtgcagtggtgcaatctcggctcactgtagcctcgacctcccaggctcaagcaatcctcctgcctcaccctcccaagtagctgggactataggcgcacaccaccacacccagctaatattttatatatatatatatttttttgtagagacagggtcttgctatgttgcccaggttggcctcaaactcctgggctcaagccatcctcccaccttggcctcccaaagtgttagaagtacagcaggcaagagccactgcaccacaccagttacccagtcttttttttttttctttctttttttggagatggagtttcgccctgttccccgggctggagtccagtgacgcaatctcggctcactgcaatctccacctcccaggttcaagcgattctcctgcctttgcctccccagtagctgggcttacaggtgactgccaccacgcctggctaatttttgtatttttagtagagacggggtttcaccatgttggccaggctggtcttgaactcctgaactcaaacgatccactggcctcagcctccccaagtgcggggattacaggcgtgagccaccgcgcccggcagttacccagtcttgatcttgattctttgaccttgaccttagcatctttctcctcccccacccccactgatgagcaacaaacctgctggggttggctgtgagggggcactggggacggtgggggcagagaggtgggccgggtgactgcctgttgggagcaggggccaccgtggggacggaggttctcatcgtcacacagggccagacctctctgccaccacacatcttcctcgcccggggccccgcccccacctcctccgtgctgagctgatacaattttgaagcgagcttttctgctgcagtcagcacaacctctgggcgcctccccacccccaccctgcccctcccgcctctgctcagcaggcaggcctgtgccccaggtcaggttggcctctctgagtgaaggctgcaccctcccttgcccccagcctgcccccttcatccccaagggaatccctgcttcaattggccccagcaggccacaccctcccccaattggccccagcagggcacacccccccccaaccctcccacctgcccactgcgggtgctccagctcctcatgggggtaagagctgggcctggactccaaccccagctcagctgcccactggctgggtgatgtggggccagtcactcaccctctctgtgcttcatttccttgtctataaactggggggctcaaaactggttgccttgtgggaaatgtcaagtgcccagggtgagagctcagtaaaccacccacaaggcatcgtgaagaccaggcactaggcagggggctagggcccttggtggttatcgttactaacattatcctcttcgggattggtttgtttgtttgttattattggtttgggttttttgggggtttttttggttgttgttgtttttttttttttttttgagacagactcttgctctgtctcccaggctggagtgcaatgacgcaatcttggctcactgcaacctctgcctcccgggttcaagcaattctcctgcctcagtctcccgagtagctgggactacacatgcccaccaccacacccggctaatttttgtatttttaatacggacggggttttgcatgttggccaggctggtctccagctcctaacttcaggtgatccacccgcctcggcctcccaaagtgctgggattacaggcgtgagccactgcaactggccttgttttttgttttttgcagagatggggtatcactatgttgcccaggctactctcgaactcctgggctcaagtgatcctcccgccttggcctcccaaagtgccaggattacaggcgtgaccccctgcgcccggcccatcctcctcattctgattataatctcccactgccagacctttccttatgcattccctggacatagaatgtctttcccatatggaaaaccccaactccggctgggtgtggtggctcatgcctgtaatcccagcactttgggaggccaaggcaggtgactctcctgagctcaggcattcgagaccagcctgggcaaaatggcaaaaccccatctctaccaaatatacaaaaaattagccacctgcctggctgaaaattctttcccattctcacagctgccctgtgaggcaaggatcattgctgtatgccttttttttttttttttttttttttttgagatagggtctcactctgtcacccaggctggagtgcagtggcgcgatcttggcttactgcaacctctacttcctgggttcaagcgattctcatgcctcagcctcccgagtagctgagattacaggcgagcgccaccacacctggccaatttttgtatttttagtagagacgggctttcaccatgttggccagggtggtctggaactcatggcctcaagtgatccgccctcctcggcctcccaaagtgctgggatgacaggcgtgagccaccgcgcccggcctgttgtacgcattttacagaggaggaaacagaggctcagaggagggatttgacctgccgtggtcacacagccgagactgggccaggtgggatttggacccacaagcagcttctgcctctgccctgtccttgacacctgcctcatcctccattattgtcagaaggggatgggcggaagttgtggtgcgtgagggggcagtctgctggcacggtgtggtcaccttctggcagggttgtgtgagggccccacaggctgaggtcttatgtagggtccccaggctgtggctggcctccaggcctcagcgctgatcccagtggttgtcaccctgacagcaggaagactggccaccggcttccttttccgaaccgagagtccccttggctgtggagcgtcctggcccagccagagtgcagtgtctggctttcatcagccctgctgggcagctgaggccctgggatagagggagagggagggacgggcatcaggcatagggccttggctggcctcttggaggggtgcagggtggatggcggtggaggggcacctgccatggggctgaaaggagccaccacttgcaacgtcacaagtgagagaggaggccgggcacagtggctcatacctgcaatcccagcacttcgggaggccgaggcaggcggatcacctgaggtcaggagtttgaggccagcctggccaacatggtgaaaccccatctctactaaaaatacaaaaattagccgggcgtggtggcgggcgtctgtagtaccagctactcgggaggctgaggcaggagaatcgctggaacccgggaggttgcagtgagccaagatcgcgacactgcactccagcctgagcgacagagtgagactctgtctcaaaaaataaaaattaaaattaataagaagagggtgtcagggaactgcaggaaaataaagcagggagggacatggaggggggctgggggccactctggatggggagggcttctctgaggaggcgtctttgaggtgaggcttgaagggggtgagggagtctggagaggctgggtggagggagcagtgagggggttatagccagtgcgaaggcctggagcccaggagcagcacatggagctggctgggatgttcagggggtagtgagtggcgagggccgtcctgtggccttccagtgagggtgaccagccgggggtggggcgggagagggtgacccgggtgctctccgacctgccacgtgctggggaaggagcctgcaggaaccagggcccagagagggaagctgtctgcccgcccagggcctaaacccagccaggcctccccgccccctctggcagcccaagaaatctgaggcgcgggcgggcaccgtgccagggctgggcgggggaggggctgccaggcccgcccgtcccagcagctgccagcccgccccgagccgccagcccagatggtgcccatctgctgacgccgccatgggccagcctcctgttcccgccttgcgtcgtgccaagctcctgcagtccagcgccgggaatggcgcggtgggcagagcccggcccgggaagctcatagcacgccagagaggctgccccgggtgccctggagagggtggcaggagaaacatgggagggggagttccccagcgcttcctggatggaattggggagcaaggaccccaacagcgataatgatggcggcaaacacacatggcgtgccctctgtgtgccaggctccgaggccaccgctcaccctaactggtttaattctctcccccatccaagcaggaagggactttggccttctctcgtgttctagtggaggaagcagagacccagaggtttggacaagagtcacttgtccaaggtcacaaagctcctcaggggcagagccggaatgagaatccagaacccctttgaaaaagggattgaggccaggcgaggtggctcctgcctgtaatcccaacactttgggaggctgaggcaggaggatcacttgaggccaggagttcgagaccagcctgggcaacatagcacgaccatgcccccccccaacaaaatttttaaaaatgagccaggtgtggtggtgtgtacctgtagtcccagctactcgggaggctgaggcaggaggatggcttgagcccaggagttggaggttgcagtgagctgtgatcccaccactgcactccagcctgggtgacaaggcaagaccttatctctaaaaaccgttttttttaaggggtgattgaggccaggtgtggtggctcacacatgtaatcccagctacacaggaggctgaggcaggagagtcgcttgaacctaggaggcggaggttgcagcgagctgagctcatgccactgcactccagcctgggcgacagagtgagaccctgtctccaataaaagggaggtggtattgaaaccccttaaacctcttttcaaaaacaaactaaaagtgccctttgaggttatctagtggaagccacaccctctgagtcatacagatcatacagtgcaggccgtgcacactcagggagtaaatgaatgaatgaatgaatgaatgaggtgaaccctatggaaggggaccaagcctggggccagggtgtccataaagctcaccctgagcttgatggcaggagaaagggtctcaacctgggagtgagggacctgggtcagccacagtgctgccctggcttgctgtgtggctttgagaaaagtcctgccctctctggtctggggttgaggggagtggagggtgggaaggggcggccttgtgggccacagacaggagcaaggcgggtcttcactgaaagcctcccgtcctcttctgcctttattgatcttcatcccggttgtgggtgctgcactggggagacaggccatgagctcgggtgacggtgcctgtttatttgtatggtggacagaatttgtgttcctgtgtgctccaggcagtgtggggcgcattcttctctttgagccttagtttttgcctctgtagaatggggagaatcagagctgtgcccattgcattaaagattggagtcagtggtctctgagaagcatacaggaggcactcaataaatgctcacttccggccgggcgcagtggctcacacctgtaatcccagcactctgggaggcccaggcgggtggatcacctgaggtcgggagttcgagaccagcctgaccaacatggagaaaccccatctctactaaaaataccaaaaattagccaggcgtggtggtgcatgcctgtaatcccagctagtcaggaggctaaggcaggagaattgcttgagcccgggagaaggaggttgcggtgaaccgagattgcgccattgcgctccagcctgggcaacaagagtgaaactctgtcccaaaaacaaaacaaacaaacaaaaagaatgctcatttcctccctggattctctccccaaccccaggagggaaggagggaggtcccagtgccgccgtgaaaccctacacctccttttcccaacccagtgagccagtgggggcaccgtgacccaggagtggctgtcaccagaagctggaccaagtcaccctttccaggtgtctggacagcagaggggtgaggggttcctggcagcagcagcctgttatcccccagggctgggcagccaggtgtgccagccgtctgtctgtgcagagaaggtggctgccgggcgtgagtcgcagacgccagctgatggtgtatttatagcaacggcaggagtccgcggggcatacgtcagtggtaaagagggacgggcaggtgggggtccagctcccacagcagacaagagcccaccaggactggccagggagctgaacagagtgtcagggagaatgaggggcatgttgtgcagccgggaggcccaggatcacacccctctgctctggaactgcgtgatgtttgacaagtgacattgcagctgtgggcctcagtttcctcccccatcaaatggggatgataataatcctgcccacctaatagggctgcataggatccaattagtgcatgaaaagcatgaggacagggcctggtatacagtaagcactcaaaagtgatttgttgcctaaaaaagggagggaatcccaacatgggccacaatgtggatgcatcttgaggatgtcacactcagtaaaataagccagacacagaaggacaaatcctgtgtgattccactcctaggaggtccatagagtcgccagattcacagagacagaaagtaggatggggggtgccaggggctggggagggggctggggagagaatgtttcatggggacggggtttcagtttgggaagatgagaaggttctggagaggatggtggtaatggttgtacaaccctatgaatacgcttaatgctgggttaatgccactgaacttagaaatggttaaaagagaggcaggaggattgcttaaggccaggagttcgagaccagcctgggcaacacagcgagacctcatctgtacaaaaaatttaaaaattatctgggtgtggttgcacgcacttgtgttcccatctactcaggaggctgaggcaggaggatcgcttgagcccaggagtttgaggctgcaatgagctatgatcacaccactgcactccagcctgggcgacagagcaagacttgtctcaaaaccagaaccacccccaccaaaaaatggtaaatttatgttatctagattttaccacaatctaaaaatgtagttctggttgtgaataatgataataacaagtaataatattatatctatggccggctgtggtggcttacgcctgtaatctcagcactttgggaggctgaggcgggaagatgacttgaggtcaagaattcgagaccagcccagccaacatggtaaaaccctgtctctaataaaaatacaaaaattagccagtcgtaggccaggcgcggtggctcacacctgtaatcccagcactttgggaggccgaggcaggcagaccacttgaggtcaagagtttgagaccagcctggccaatatggcaaaaccccgtctctactaaaaatacaaaaattagccaggcatggtggcgcgtgcctgtaatcccagctacttgggaggctgaggcaggagaatcacttgaacccgggaggcggaggttgcggtgagctgagattgcaccactgccctccagcctgggcaacagagtgagactccgtttcaaaaaaaaatgttatatatgtaacaatgtaataattagtaatatgtcatatataatcatggaacaataaataagaaaaatagtgtctgcggtgacagcacagtagttattattgtcgttatcatgatcgtcatcactgtggttctcgtccagctctgccctgcagacagctgtgtaaccctgggtgagtttcttgccagctctgtgctttactgcctcatctgtgaattgagcatagggggtgcctagcaatttaaatgagataatagctcttttttttttttttttttttttgagatggagtcttgctctgtctcccaggcaggagtgcagtggtgtgatcgtggctcactgcaacctccacctcccgggttcaagtgattctcctgcctcaacctcccgaatagctgggattacaagctcatgtcaccacacccggctaattgtggtatttttagtagagcgggggtttcactatgttggccaggctggtctcgaacttctgacctcaggtgatctacctgccttggcctcccaaagtgctgggactacaggcgtgagccaccgcacccggcctaaatgagataatatctatgaaaaaactaaccctttgcatgtgatgagtgctgggaactggtaggctctttgaggagtaggtcctcccaccaccccgcagacgcccctacccagcagaatgctggtttctgcatgaatgcatttgtgtggggactcccgagacagcccctgagggagccctcattcacccgggtggggcccggccctcccagagccagtgggagggggaggcgccttgttgcacctgtgatgccccccgttatggctgggctgcagttgtcaccctggccctgtgcctgggaagccaaggggaggctgagggcagctagggacagctctgtgcccacggccccctccagccagctgccaggccagccccctccctccagctgggcgagggcaggaagtcacagatggtcagggttggtgaggggtgaagcagagggcatttggggacaccggatgtctcgtccagatggggaaactgaggcccggagaggggcgaggcattgccccgagttgcccaggaagggccttggctcttgtcccttctaagtcccatctttatttttattttttattttttggagacggagttttgccctgtcgcccaggctggagtacagtggcgcgatctcggctcgctgcaacctccgcctcctgagttcaagcaattctcccgcctcagcctcccgagtagctgggattacaggtgcccgccaccacacccagctaatttttgtatttttagtagagatggagttttaccatgttggccaggctgacctcgtgatccacccacctcggcctcccgaattgctgggattacaggtgtgagccaccgcgcccagactaagtcccatctttaggtccgcttggctgttccacggccacctggaggggaggtagggccagcaaggagggaccctagggtctcagggcagaagatctgccggaggagagggagaagggggttctgaggggaggaagacgcgagaatctcaacgctgaagtggtttctagattctccagggcatgagtcctgaaatccccaaggcctgagttctagaatttcttccactggggccctgaccacacaggtgattctagaattctcctaggtgagttccagacccaggggtccaggagaaatagaatgttggctgggcgtggtggctcacacctgtaatcccagcactttgggagaccgaggagggcagatcacttgaggtcaggatttcaagaccagcctgaccaacatgatgaaacccggtctctactaaaaatacaaaaatgagccgggcgtggtggcgcgaacctgtaatcccagctactctcaggaggctgagacaggagaatcgcttaaacccaggaggcagaggctacagtgagctgggatcgtgccactgcactccagcctgggcaacagagtgagactctgtctcaaaaaaaaaaaaaaaaaaaaagagttccaaccacacatataatttaacatttttctggtcctcacacttaagaatgtaaatttaagtatactggggaaattaattttaacattattttaagtaatgttaattttttttttccttgagacagagtctcgctctgtcgcccaggctggagtgcagcggtgcaatctcggctcactgcaacctccacctcctgggttcaagcagttctcctgcctcagcctcccgagtagctgcctcagcttcccgagtagtaacattaaaatgtttaattttaacattactttatttaacccagggcatctggaatgatactattgcaatccataaacaacaggaaaaattattggtctattggtcgggtgcagtggctcacgcctggaatcccagccctttgggaggctgaggtgggaggatcacttgaggtcaggagtttgagaccagcctggccaacatactaagaccttgtctctacaaaaaaattaaaaaattagccaggcgtggtggcgtgaacctgcggtcccagctactcaggaggctgaggtgggaagatcgcttgagcccaggaatgtggggctccagcgagctgtgattgtgtcactgcattccagcctgggtgacagagcaagacttcaactcaaaaaaaaagttatcgaggtattttatgatcttttccccacccaccccccacccgcttacactaagtctgaaatttggacagaccacatttcaagcactggatgtcacacgtggccaggggctgctgtattgggcaggccgtgctaagacatctgagttccagagcaggggttcccgacccccgggccacagacgggttccgtgcctgggaggaacctggccactcagcaggagttgagcttagggcaagtgaccattctcacctgagctccacctcccgtcagatcagcgggcggctctgggtgcccctacgagcatgaaccccatggtgaactgaacataggagggatccaggttgcgtgctccttaggagaatctgactaatgtctaatgtctagtttcatcccagaaccatctccccactcaccccgtccctggaaaaattgtcttccatgaaatcggtccctggggccaagaaggttggaggctgctgttccagagaattcggaagcagatctccagtctcccaagttgggttctcgaaaacgtgagggcaggttctagaccttccaaactggttgcttgaaaatccaaggaggctgggcgcggtggctcacacctgtcatcccagcactttgggaagccgagacgggcggatctcccgaggtcaggagttcgagaccagcctggccaacgtggtgaaaccccatctctactaaaaatacaaaaatcagccaggtgtggtggtgcacacctgtaatcccagctactggggaggctgaggcaggagaatcacttcaatccgggaggcagaggctgcagtcagcagagatcgcaccactgtactccagcctgggcaacagagtgagaatctaactcttttgcccagactggagttcagtggtgcaatcacagctcactgcagccttcaactcccaggttcaagtgatcctcccaccttagcctcctaagtcgctggggctgggattacaggcgcataccaccatggttgattttttttttttttttttagtagagatgaggtctcactatgttgcccaggctggagtgctgtggtggactcatagctcactgcagcctcaatctctcaggctcaagggatcctcctgcttcagcctcccaggtagctggcagtataggcgtgcaccactacgcctggctgattttttatttttatttatttatttatttactttttgagacggagtcttgctttgtcacccaggctggagtgcagtggcgcaatcttggctcactgcaacctccacctcccgggttcaagcgattctcctgcctcagcctcccgagtacctgggattacaggcgcgtgccaccacaccggctaatttttgtatttttagtagagatgggatttctccatgttggccaggctggtcttgaactcctgacctcgggtcccaaagtgctgggatgacaggcatgaactaccatgcccggccttatttttatttttcgtagacaggaggtctcactatgtggcccatgctgggatttcaggctctttgagctttcttccatattggttagggctggagcaggactccactgtggcgggaggtatttgggcgcaaggagagcagttgtgaggactggtggtgacccccagttactgtctgttgtgctttggatgctgggcacgggaagcctggctgtaagtgtgtgtttccgggccgggcgcggcggctcacgcctataatcccagcactttgggaggctgaggtatgcggatcacgaggtgaggagatccagaccatcctggctaacgtggtgaaaccccgtctctactaaaaatatgaaaatattagccaggcgtggtggtgggcgcctgtagtcccagctactcgggaggctgagagaggagaatggtgtggacctgggaggcggagcttgcagtgagctgagatcgtgccactgcactccagccggggcaacagagtgagactccgtctcaaaaaaaaaaaaaaaaaaaagtgtgtgtttccaagaggctgttatggggcctcgggcacaccctcactgggtctggatcccagcctgtctaccaccaggcgtcccttctggtgaacagagctatgtgagaacttccaacagggacaccacggccgctcgtagcccagagcttgcagagctttgttcaaaggcaatggcccagggccgagcacggcggctcacacctgtaatcccagcacttgcagaggccaaggtgggtggatcacctgagatcaggagttcgagaccagtctggccaacatggcaaaaccctatctctactaaacctacaaaaattagctgggtgtggtggcacatgcttgtagtctcagctactcgggaggctgaggcaggagaatcgcttgaacccaggaggcagaggttgcggtgagctgagatcgcgccattgcactccagcctggtgacagagtgagactccatctcaaacaaacaaacaaacaaaaaagcagtggccatcatgatcggttgtgtcatctagtgggaggcaggggtgtgtctgcatgcgtgtctggggtgcattgtggggggattgcaggcgtattgagggcttaccaagtgcctggctcatctgagccctcaggaaaccacattgttggcagctacctcaccgtctcacaaccacccgctgaggttggaatgatcattaacagcatttaacagatggggaaactgaggcctagagaggcaaagtcactggcctaaggtcacatagctaaggagcacagtcaggatttaaatccaagcctgggagatcccaggacccacagtgggcaccacataaaggggctgtttggggtatggcagggactgccctggaacgttccggatcctgcctttgggcctacagggctttggtgccggtgagcaggccgcaggttcagctggctcaaggagcagcttcagggctgcagccaggctgggggctgggcaggtctcaaacccctggacctggggaatcagggaggtgtgagctgcatctgaggtcgggtgtctctgtgactctgtctctgtctctctacctctgattctccccaggctgccttgtctcagtccctgtctattcccaccccacctcgctctctctcccggccttgcgagtctcctcccagccccccatcccacccagtgggctgcccggaggtggcggcaacggggcagctgaatgggcctcttgttcctggccacacccgccccttggggtcaccctgggacatgcccaggcagcgtggctaccttaaagggccagtgctcagaaagaatgtgagcgggggaggctgcgtccactcccaaatcccacaccctccccaaggtggaccactcatgtgtctgacgggggtggggagctgtgtacctacacaccctcgtggcttgggggaggcctgtctggagcaggagatgtgatagggtttgggtttgaccttggataaatcccttcatctctctgtgcctcagtttccccatctagatcagggggctccttggtgccacccctgtgggttgctgggcagatggcatattatccaggattttgcacacagttgacactcttccggcgcccactgtgcattgatagagcacctgctgtttcagcccagcattcatccgccgtgcagacttggcaattccttcttcaccttgctccgtgcctcagtttccccaaatgcagaatgaggcgatggctgtcttagcttcacagagagctacgcaaggattgagtcggttcgtggaattagagggtattagggagaagggcctgaaacactgccaagtgtcacctccactggcgcacttattgagcgccagctgcataccaggccttgctgaggaagcctcactgcagaggttgcagtgagctgagaggcaaaggccacccagcctggatctcactctggtgtcatcgcctcctccctctgctcagggttgtgcagcttcaggctgctcccctgccctctctgggcctcagtttcaccttcagagcaacgggaacagccccatcctttcacacactggaaaccatcaccttcttctgcctgggagggggttgtgctgtctctgggaatcccaggcatcccccaggcaggagtcaacccagaggccctcggacccgggctgtaccctgtgacagctccgggtggctacgacgctcccgtgctccaggccagccccacagacagcccgggacaggttgctgccggatggacaagcctgtgcctcgctgccttatgtaaccagtttatgcaagggcagccggcccgcttacataaggggaggccgggccagcgcccagctggggagggggaggctcttaaagggaccggcgtcccccgcggctccctccacgggcactggtgcgaattcataggcgagctgcggactccgccctcagcaaggccgccattaatgtcgttatgattatttttgtggatgttgtttatcatcactatattctttccccagggcgggggttcagctgagcggaggaccacgcccagtgcttgggcagaggcttgggctgtgacgctggctctgggtgtcacctggttaagtccctgtctctgagcctcagcctccccttctgcacagtggggcaatgcaggaagacgtgaggtcctggagggtcctggccctgctgcctgttcactgtgtggcctcaggcaggtggcatcccctctctgggcctcagtttccccatctataaaatagcgcctgctctgtggggttgctgagggagagtcaataagacatattaagagtttacatgcccgccaggcatggtggctcacacctgtaatcccagcgctttgagaggctgagacgggaggatcacttgaggccaggagttcaagaccagcctgggcaacatagtgagatgcccatctctacaaaaaataaaacttagccaggcatggtgatgtgtgcctgtagccccagccactcgagaggtcgcggcaggaggattgctcaagtctgggaggttgaggctgcagtgagctgtgattgggccactgcactccagcctgggtgacagagcaacaccctgtctcaaaaaataaaaataggccaggcatggtggctcatgcctataatcccagcactttgggaagccgaggaagacagatcacttgagatcaagagttccagaccagcctggccaacaaggggaaaccccgtctctactaaaaatacaaaaattagctgggcgtgtggtgggagcctgtaatcccagctactggggaggctgaggcagaagaatcacttgaacctgggaggcggagattgtagtgagccgagatcgtgccactgcactctagcctgggtgacagagcaagactccatctcaaaaaataaataagtaaataaaaataaaaataggctgggcacagtgactcacacctctaatcccagccctttgggaggctgaggcgggaggatcgcttgagcccaggagtttgagaccagcctgggcaacatagcaaatctctgtctcaaaaatttttgaaaacaaaagagtttaggacagcacggagcacagacactgtcagcactcatccagtggaaccactttgcagccaataaatatttagtaagctcctactgtatgccaggcactgctccaggcgctgggatactgcagtgaacaggacagataaaaattcggccctggccaggcacggtggctcacacctgtaatcccagcactttgggaggctgaggtgggcggatcatgaggtcaggagatcgagaccatcctggctaacatggtgaaaccccgtctctactaaaaatacaaaaaaaattagccaggcgtgatggcaggtgcctgttgtcccagatcctcaggaggctgaggcaggagaatggtgtgaacctgggaggcggagcttgcagtgagccgagatcacgccactgcactccagcctgggtgacagagtgagactctgtctcagaaaaaaaaaaattctgccctcgtggaactcacagtttggttcaggcgatgggcaaagaacaagaaataaatgtcagtttaggcttagtgcggtggctcacgcctgtcatcccagcactgtggggggccgaggcgggcagatcacctgaggtcaggagttcaagaccagcctggccaacatggtgaaaccccgttcctactaaaaatacaaaacattagccaggcatagcggtatgcgcctgtaatccagccactggcaggggctgaggcaggagaatcgcttgaacccggaaggcggaggttgcagtgagccgagattgtaccactacactccagctggggccacagagcgagactccgtctcaaaaaataataataataaaaataaaaagaaataaatgtcagtttagcgataaggactatcaagaaaaataaagaaggccaaaggaaaagaggctgatgggctgtgctggggaggtccctgaaaggctgtctgaggacctgacatttgagctgagacctgagaagtgaggaggaaccagttatatgaagaactgggggaaggcgttccaggcagagggcacagcccgtgcaaaggccctgcggcaggacacacctggcactttggaggaacagtgaggaggcctgtgtggctgcagcagagtgaggagaggaagagaaggaggaggggagggcagtttgtgcaaggcctggtgggcagtaggaaggacttgggctttgaccccaaggcaggtgggagccatagagggctatgggcagaggagggaccagccctgactcaggtgctcacaggcaccctctgcctgctgcagggaggacagactgtggggggtgagggcaggagctggggaccagggcagagtggaccgccctggtgcaagcaggcggtagcagggacagaggcagaggagggggcagaatccaggtcaactccgacggtgtgaggattcagttgctcacctgggtcgtttataccttatctgaggctggcccttgctctccttgccccgtctcctgcctgcaagccgcacctgcctgggcacatgcagggaagggagcggcgcagcactgggcacgcctgggagctctcctgcaatcaggactttgttagcgggcaagctgggatatgggtcctggtgcccgggaggcccgtggggctctgggctcctgccagggtcccagccctaacccaggtacgccacccacatggcagggttattctctttttttttctctttttttagacagagtctcgctctgtcacccaggctggagtgcagtggtgcgatctcagctcactacaacctctgcctcacaggtttaagagattctcctgcctcagcctcctgagtagctgggactacaagtgtgcaccacctcacccagctaatttttgtgtttttagtagagacggagttgcaccatgttggccaggctggtctcaaactcctgaactcaattgatccaaccgcctcgacctcccaaagttctaggattacaggtgtgaaccaccgtacccagcctattctcatttattttctttcttatttttttttcttttttttgagacgaagtctcactctgtcacccaggctgaagtgcagtggcacgatctcagctgactgcaacctccgcctccagggttcaagcaattctcctgcctcagcctcccaagtagctgggactacaggcatgtgccactatagccagctaatttttgtatttttagtagagatggggctttgtcatgttgacgaccaggcaagtctcgaatgcctgacctcaggtgatccacccagcctcagcctcccacagtgctgggattacaggctggagccactgcgcccagacggtccttccttttcatgcctcctccttccactcccccatgtaccatgtctccttgtctctctttttctctctgctcatccctccctctcaactttctttctacaaatatttattgagcacctagtctgtatcaggccttattctagccactgagggcacaacagagatctagacagacaaagcctctgccctcaaggaggtgacattccactggggagatgagcaaacacccgtgcagtcactaagcaactaagcaaatccataggcaatcactaacttcctctgaaggaaagaaaacagaaggctgagattgagggtagccagaggctgcttgaggtgaaggggctcagcgtagacctctctgagaagggagcatttgagctgagaccaggagagatctcaagagagagcaagcagttagctgtttagacagagggaacagaatgtgcaaaggccctgaggcaggactgggccaggtgcattggaggaacagcgaggaggcccctgtggctggagcagagtgagtgagggggagagagggaagaggggagggcagaaagcggacaggacaggttgtgcagggcctgtggtcctagtcctccactttgactactcccccaaatctcttaatgttcctcacattcctttccctgacaagcatttattttgcacctgctgtataccagatcctatcaggagaatcccaaatattcatgcaacaagttcatattgggtgcctactgtgtgccaggctctgctggaataatcacactcatttggctgcaggcatttattgagtgccagctgtgtaaaagcatttatcgagcaccacctgtgtagcaggctctggggagagaggccacatgaaagcttgggaaggagaaagtttccttctaccccctttcaggtttgtgccctctggtttccagccccctcccacattcaaggcaacatttaaacctctgggttcaagttccgttgtccaactgcgtggccgtgagatctgcggcaagccccttcctctctcggatcttccgtttccccctttgtaaagcagaacactccacaatctgatgtgtttacaacttgacatctactttttgcagcaagggaaactgaggcacagagcagggcggagatgtgtctacctctccctccccaagcaagactggcatggagtctattctcctgaccccacgccaaagccagggcgtttggtattttgttttttcttggaggcccagagaggggcagggcttgcctgaagccacacagcaccgggcaggcctcggaattgcggagagccctcccctgggcgcctgcccgggctcccgcgccttcctcctgcctcctttggctgggccgccagccttgcctcccgtcctccggactccccgcgggctgcccagttggagacgcgccccaagaaatatcagaaggaaggggaagccgggaggggcctccgcctcctcccgccaccccccgccgcgcccggctgcccccacccggtgcccgacattggcagagagtgtcctcgggcgcttccgactggccctgcctgcttcgtgtggccactgatcccttccggagcctctccatggggacgcccgtgtgtgcgctcagccagtggcacatgtggctcccggggctcccttctccacccccccagcccctggcctgcccctttccccccatcccttcccgaacctctccatggggacgcgtgcgtgtgcgttcagcccgtgggcacatgtggctcccagggctccccccgaggcctgcccttctcccccccccgtcacagccgccgagtcaggcctgccaggaaggtgttgggggtgggggtgtggggaggcctcagcttggctgctgggaagccaagaatttgctccaaatgtaaacagcgagttattttcagtccactcccccccaccccgggtggcgttgacacatttgacattggcgggaccgggagggggtgggggtgagggtgtgcgtgcgggtatttttaaccttgctcctcacatccctggagtggctggtgccgagtggcagataatggggagggggcgcggaggcgtggggagccctgggtggccgtgcgcgggtgggcgcttggcaaggccgccctgctgttggcaccacgtgtttaacccctcagaggctgcagaggggctgggggaggcggcccagggcccagtggtgccccagaggctcccttgtcaccttctcctggtgtccccccacccccaccccacccaggagggcagggccgggtgcccgaggccggtgccagcctgcgccgcccagacctacaaaatggccgccaaggccggagaaacatctggaacaggggaagggagaggcgagaaaatggccgccagagggatgatgtcatgggcggcgtggcctcccagagcgtccccagcacggggcgagtccctacgcgcaggcctccgagcaggggccctgcggcctccagggacctccagacccgctgcccaggccggacacccacaaagagtgacaccggggtccccaggggtccccagaggcgggcccgagacctgggggagggcgaggccagcactgggcctccagtcccaacagcccgatgctggggacggttccggggcggtggtggccgctgacctgacccgcaggacaccgaggcgtccaccagcgcccgggagggcccggagccaggccatggagccggcgggggccgggtggaaagaaaaaagaaacttttctttgaaagtgattccgaagcaggttggctccggcccaggcggcccggcggcaggggagagggagatggaaagtatgggccagacttaaggaacgcaggaaggacgaggccggggaggcccgggatggaggccagcgtcctggaggtcaccccgtccacgcctctgcctctcgggcccccccaggtcacatccagattttcctccctgtccctggggcgggcggggagtgcggagaacatctatgggcttgtgttttttcctcttttgatttgtccagacaggcgatggacaagggctgggcaggggttttaggtcatctgcactgtcaggatgtggaggctcagagagggagagtgcttttagtgaggtcacacagcactggcaaaactgacagctgcttccctccttagagcatcttggggaggaggaagttctctatggaggatcagggtccgtactggaattcctttctatttttatttaatttaatttatttatttatttatttatttttgagatggagtttcactcttgttgcctaggctggagtgcaatggcacgatctcggctcactgcaacctccacctcctgagttcaagcgattctcctgtctcagcctcttgagtaactgggattacaggtgcctgccactacacccagctaatttttttgtatttttagtagagacaggggtctcaccatgttggccaggctggtctcgaactcctgacctcaggtgatctgcctgccttggcctcccaaagtgctgggattatacgtgtgagccaccgcgcccggcccctttttctttttctttcttcctttctttttttgaaacagagtcctcctgctctgtcacccaggctggagtgcagtgacttgatcatggcttactgtagcctcaaccttctgggctcaagcaatcctctcacttcagcctcctgagtagctgggaccacaggcatgtaccaccatgcccagctaaatttgggttttgtttgtttgtttgagacagagtctcactctgttgcccaggctggagtgcaatggcacgattttggctcactgcaacctccacctcccaggttcaagcgattctcctgcctcagccttccaagtagctgggattacaggcacccgccacgatgccctgctaattttttgtgtttttagtagagatggggttttgccatgttgcccaggctggtctcgaacttctgacctcaagtgatccgcctgccttggcctcccatagtgctgggattacaggcatgagccaccgtgccctgcctatttttttttttttgtagaaatagggtctcactatgttgctcaagctggtctcgaacttctgacctcaagtgatcctcttgccttggcttcccaaagtgttgggattacagcgtgagccactgtgtccagccaatgtctgtgtgtttttcactgctctgtccccagtacctaggacagggcatggtacacagtaggcgctcaagacgtgtgttggataaaagcatcacagttttctcctgaggctggggttggcacagatgctggcacaggaagggggcagaggctcaggaaatgcaaagtaggttgcaacgtaactggacacacacgggaaccctgtggtcacatttttcaggagggatgtgaggaggcgaaaactcaaacttccctcacttcaagtgcagattctgtgccgggagctgtggacgataaaccacatttgaacagaagcctgaataaagcgagagagtgagccaggcaggcatttgcagggacggtgttccaagcagtgtgcacagcccgtgcaaaggccctgaggcaggaccgtgcctggtgcattggtggaacagccaggaggcctgtgtggctggagcagagtgagcgagggggagagagggacgaggggaggaggggagggagggggcagaggcgggctgtgcagggccttgagcgccatggggagatggggagaacttggacttttagatatttggttttctgttttttgttttttgtttttgaggtggagtctcgctctgtcgcccaggctggagtgcagtggtgcgatctcggctcactgcaagctctgcctcccgggttcacgccattctcctgcctcagcctcccgagtagctgggactacaggcgcccgccaccacgcccggctatagttttgtatttttagtagagacggggtttcactgtgttagccaggatggtctcgatctcctgacctcgtgatccacccgcctcggcctcccaaagtgctgggattacaggcgtgagccaccgcgcccggcccaattgtttggttttgtttttgctttgttgttgttgtttttgagatggagtctcgctctgtcacccaggctggagtcactggtgcaatcttggttcaccgtgccctctgcctcccgggttcgagcaattctcctgcctcagcctcctgagcatctgggattacaggcatgcaccaccacgcctggctaatttttgtgtttttagcagagacgaggtttccgccatgttggtcaggctgagctggaactcctgaccttgtgatctgctcgccttggcctcccaaagtgctgggattacagacgtgagccaccgcgcccgggtgaactttcacatatttgtagacccagacacagtccagggtgctggggactagaacaaacgtttgcagaaagggctggggagggtgttccagagaaggagatgtcagagctgggctgcaaagtatggctggaggtttcctaggagggagaggggcagggaagacggcacagcaggagctcagaggactcaggcccaggtcactcgtatattccattgccttccaggacagagaaagttgaaccttcgccgggtaatgtttaaaaatggccggtgacacccagtagctgggaattccagggcctggctttggttctctctttagctggctgaggttgggaggcggacgtggcagccggcagagccagcaacatttggaagccggctaacgttggaaaatcaaccaggcgagctcacggtggcggccgatgctggaaacctgggctccgtgaggtccagcagatgccctgctggggcccaagtggacattctaggccttctgacagcccgccgggtttttaaataagtgtgattatggtttcagcaagtcctgtccttcctacagccaaaagatcaattcaatatggccactccgtgcaatgctgggccacccctgctgggccagggtgttgtgttgaagccaagattcccaacacctgagagtccagaagtttctttaaaaattgctttaactgtggtgagacacacatcacacactttttttttcttgagacagggtttcactctgtcacccaggctggagtgcagtggcactgtcatagctcatcgcagcctcaaactcccaggctcaagcaatcctcgcacctcagcctcctgagcatctgggaccacacatgcagcacgcaccaccacacccagctaatttttattttattttattttatttttgagacggagtctcactctgtcgcgccaactcggctcactacaacctccgcctcctgggttcaagcagttctcctgcctcagcctcccgagtagctgggactataggcgaccgccaccacacctggctaatttttgtatttttagtagagacaaggtttcaccatgttgaccaggttggtctcgaactcctgaccttgtgatcccaaagtgctgggattataggcgtgagccaccgcccctggctgacacccggctaatttttaaaaatattttgtagagatggggtcttgctatgtggtccaggctggtctcgaactccttgcctcaagtgatcctcccacttcagcctcccaaagtgctggaattacaggtgtgagccactgtgcccggcccagagacttttgaaagtctaaaatggattgtatcatagctcacatcactcctcttcccactgcaggataaaacccaggcctctcactgcaacacacaaggccccgaatggtcccgctcccctctccgttcgttcctctttctcttgcccaccacgctgcagcctggggtctgtctctgcctttcacacatccaacttcattcctgccccgtggaccttgcccttgtcaccgaacctttgtggaacgctttcaccccagctctccacatggctgggctccttctcccgctggagagccaccgtcacatcctcagagaggttctgcctgagtcctccctccaacgccgcccccaaagccattctgccttccgccagtttcattgcctccgtagaacctagaaccgtgtgaaatgatctgaggcttcctccatgcactggttctgcccgtctccctccccacttccttctctgccatccccccaaggcctggcgagtagtaggtggtcagtaaacacctgttccgtgagtgccgggtgtgcgttgacctcccagtcaccaacggcggaagcttcagccagcggacgcagggagttgtcccttgcaaagggggtgggtgctcccgggcgggaagggtggggccagagcccacggcgatgcctttgtcatgagctaggatggactgaatttgggctcacagccacggacaggagagaacagtgtgtccgccccgtcagtgccatccagcgtgcgtggctgttgtgcatcatttgtttgcttgagcaaaggctacagggtccagtgacattcttggcagtccatgacacctcacagacctgggaagtcaagagacctggctcccggccagatgagggtatcatttgaaatacaatttgctggccggctgcggtggctcgcacctgtgtttcccctactttgggagacagaggtgggaggattgcttgagcccaggagtttgagtccagcctgggcaacatagcgagactgcgtctctactttttttttttcctgagacggagtctcgctcctttgcacaggctggagtgcagtggttcgatctcggctcactgcaagctccgcctcccgggttcacgccattctcctgcctcagcctcccgagtagctgggactacaggcgcctgccaccacgcccggctttttttttgtatttttaatagagacggggttttaccgtgttagctaggagaacaacaatttgctttccagaaccagagcctctcaacactagcatgtgtgtggtcatccatgctaaatggtgctgaaagaggcatttgtgtctctctgagaaggagctatttgaggaaagtcctgaatgaggggagagaatgagccatgtagatagctgagggaacagtgttccaggcagaggcgcagcccgtgcaaaggccctgaggcaggaccatgcctggtgtgttggaggaacagcgaggaggcccccgtggctagagcagagtgaggaaggggagacaggaaggaggggagggcagggaggggactgatcgggccatgcagggccttgtgggccacgggaagaaggtgggcttttccccgcaaagaaggtgggagctatggagggctgcgggcagaggaggggtaatgttcatttaactcctggagtttgacaaaatgctatcatcaaaacagactttatcacagaacctctagctatccccgtcccctccgtaagctcctctgagcatagcaacagaacgggaaggtaaggcagcgattggaaacgcccgcgttatagatgagcggagagccgctggaggttggaggctccgacagaggaggtgactggtccagagccacatggccaggttgtgctggggctggaactccatcgaacgcaggtttcagggtgcagcccttgtttccataagataccccaaaatcagacaagcctgggacttgccacctcttctttaaaaaccccagtgctgtttttgttgttttttttgagatagggtctccctctgttgcccaggctggagtgcagtggctcaatcatagctcacccactgcagccttgacctcctgggctcaagcagtcctcctgcctcagcctcttgagtagctgatactacaggtgtgcatcaccacagccaggtaacttttttttttaaagtagagatggggtggggtatcctgtattgcccaggcttgtctcaaactcctgagctcaagtaatcctccctccttgaccttccaaagtgcaggaattataggtgtgagccaccatgcccagccctccagtgctttttttttttttttttgagacggagtcttgctctgttgcccaggctagagtgcagtggcacgatctcggttcactgcaacctctgtctcccgggttcaagcaattctccttcctcagcctaccgagtagctgggactacaggcacacaccaccatgcccggctaatttttgtatttttagtagagaccaggtttcaccgtgtcggtcaggctggtctcgaactcctgacctccagtgatctgccctccttggcctctggggattacaggtgtgagccaccactcccggccctccagtgcattttaaaggctctgaaaagtcctacgttgtcctgaaaactcctcagtgatgctgaacctttttgacctgtgaaccccaggtttgggtaaagtctgctcacatccggcggcacacccataggaaacccccagcccggctgtgaggagtgtgaactttgattcaccaggtccttggcccagctttagtttctcccgtgtccgtgtttgcttgtgcaatcatgaatatatattgaccagcaccaggtgccacattgaacagtttgtccgcgccgtcagtgccatccggcatgcacggctgttgtacatcatgtctttgcactggactgagctcagctgcagaaagcagcacatttcagagggtgtctaccgggccaggagaaaacacacaaaccgccaacattttaaagcctgtaatcgacatcgtatacaattggaaaagatgttcatttatatgttttgtttttgttttcttaagacagggtctcagtctgtcacccaggctggaatgcagtggtgcgatcatagctcactgcagcctggagctcctgggctcagacgatccacccacctcagcccccagagtagctgggactgcaggcacaggccaccacgctgggctaatttttagatttttgtagagatggggtcttgctctgttgcccaggctggagtgcagtggtgtgatcttagctcactgcagactcaaactcctggattcaagccatccccacctcagcctcccaagtagctgcgactacaggatgtgccaccatgcccagctaatttatttttatttttatttttgctagagagagtgtctccttatgttgaccaggctggtcttgaactcctgacctcaagcaatcctcctgccaaggcaatcctctcaaaatgcagggattacaggtgtgagccactgtgcccagcctgttcatacgttttaaagagaggtgcagacaaaactgggttggtgcatccacatccctctctgtgtgatgctgggtaatttgcttaccctctctgggtatcctggagattgtcagccccagccaaggatggttaaaaggcattaaacaatacctaggacagagcctgacatctggagctcattaaaccatccgtacatgcagatgtcgttataattattatcaatgctattctgtcactccacaccctgactcccacctcagtggccccaggtgggggtgctctgaaatttctctggcctggctgagcgggaggggccggggttctgctggaataaagaacagaggaggaagccttgaaggatttgttctgtcccagctgtccccagtatcacagttagccacacggatggcagaagggacctttgacagtggacacaggggctggaagggcccagcctggggctcactgcaatctccgccttccagattcaaatgatcctcctacctcagccttccgagtagctgggattacaggtgtgtgccaccacacccggctaatttttgtatttttagtagagatggggtttcaccgtgttagccaggctggtcttgaactcccgacctcaggtgatctactcacctcagcctcctaaagtgctggaattacaggcatgagtcaccgtgcctggccttggggctttatctgactggctagagaatgggattcaaacaccaggaatcatcccaaaccgccaatgagaaggagccctggagtgaggggaaccgagacccctcctaaaaggatttacagggtgtcacagaatcaaaattacagcaaaggctcaactgtgagatgccagggtggctgatcattgattctagacccatcactaccagctggtgttctgtgagtttgaagccattgctgtctagctttgtgcctcagtttccccagctggcgattaccgtcccccatatggggacggtaatcacgtgtctgctgcagaggagttacaaagatttgtgaggcaatggaggcaacatttgcagccgaacctagtcaaaggaattactcactgcgcattaatttgttgttttttgagatggagtctcgctctgtctcccaggctggagtacaatggcgcgatcttggctcactgcagccatcccccgggttcaagcaattctcccgtctcagcctccggagcagctgggattacaggcacgcaccaccacgccaggctagtttttgtatttttagtagagacagggtttcgctatgttggccaggctggtctcaaactccaggcctcaggtgatcctcccacctcagcctcccaacctccctagcatttcaacgacctgaagtgaccctcttgatttattttctgacttgttcatttcctgtcacgttcccattagaacatcagtgcctcgagaggagggattcttgtctgtctctgttgccgctgtgtcccttgggcgtctggcatccgggtggctctctgcaatctgtttgctgagtgatcaaaggaaagaactaatggcaacatagtgcagctccaatgtacagatgaagaaatccaggctcagagatgtggaagtacttgcccagggccacacagccggaagcccgccaactcttttagtaaagggccagtgacactgtaaacattttaggcttttaggcaggtcacatgcagtctctgttgcctattttttcttttgtttacgaccctttaaaaatggaaaagacaggccgggcgcggtggctcacgattgtaatcccagcactttgggagtccgaggcggacggatcacgaggtcaagagttcgagaccagcctgaccaacatggcaaaaccctgtctctactaaaaatacaaaaattagctgggcgtggtggcacgtgcctgtagtcccagctactctggaggctgaggcaggagaatcacttgaacccgggaggtggaggttgcagtgagccgagatcacgtcaccgcactccagtctgggagacggggcgagactgcatctaaaataaaataaaataaaataaaataaaataaaataaaataaaataaaataaaataaggaaaagaccatacttagctgactgtgcaagaataggcaaccccttctagtttgctcatctaatgtcagaacccacgaactgattccaaaaccctccacagagaatctaaaatgctgcaaaccccgactctgtgatgctggggatctaaagtgcttagtttgtttttttgtttttttgttttttgtttttttgtttttgtgttttttgagacagaggctcgctctgtggcccaggctggagtgcaatggcatgatctcggctcactgtaacctctgcctcctgggttcaagcgattctcctgcctcaacctcccaagtagctgggattacaggtgcctgccgccacacccggctaatttttgtatttttggtagagacggggtttctccatgttggccaggctggtctggaaatgctgatctcatgtgatccaaccgcctcaggctcccaaagtgctaggattacaggtgtgagccaccgtgccctgccaagtgcttggttctttagtctggagtgcagtggtacgatctcggctcactgcagcctccacctgccaggttcaaacaattctcctgcctcagcctcctgagtagctaggactatgggtgcatgccagcacacccagctaattttttttttttggtacttttagtagagatggggtttcaccatattgtccaggctggtcccaaacccctgacctcaagtaatcctcctgcctcggcctcccagagtgctaggattacaggtgtgagctctactgcgcccggccaagtgcttggttctttctcgactcaatcctattttgttctacacaggtcaggtctgcctccactcccccaaccccatgccccatttcacccattggcctctgaagcccagagatgggcaggggtttgtctgagaccacacagcaagaggggcagcagaggaggatgggaacccagatctgcttccctcccaggctacacccctgtagccccccaacccctgcaaacttgttatttaagcctcctcattacaggggtttggagccgaggaagccctgctgccttttcgtaaatgctctccctagacagcaatctttgatggaggctctgggagaagttgttcagtgatgtgcatttgtcgagcacctactgtatacctggtgccagtatagggttgggtggaagggtcttgtccactcaacacccctttttctgccctattattgccttccctggccaggcgaggtgactgacacctgtaatcccagcactttggatggctgaggcaggaggagcgcttcagccctggagtttgagttcagcctggccaacatagtgagacctcatctctacaaaaaaatgtttgttaaaaattagccagatgtagggccacaagcctgtagccccggctacttgggaaaagaaggcaagagaatcacttgagcccaggaggtcgagcctgcagtgagctatgatgacaccactgtcctccatcccgggccacagagtgaggccctgtctcaaaaaaaaaaaaaaaatcaagaccatgattgcccccccataaagagcccttttaaacattttttccctaatcactctcctgtgaaattttaatagcataggtatattttatatacctatatatattaaaaatgtacctgtgccatcaaatatatataatatatattatacataggtatataaagtataactatatgtcatatagataggtatataaaatgtacctatatggcctgtaggtatataaaatatgccatataggtatataaaatatacttacgccattaaatatatatttaatatacaaatatatttgtttttttctatactgtaacaacatatgtctgtacattattattattattattattatttttgagacagagtttcactcttgttgcccaggctagaatgcaatggcgtgatctcggctcactgcaacctccgcctcccgggttcaagaagcaattttcctgcgtcagcctcctgagtagctgggattacaggcatgtgccaccgtgcccggctaattttgtatttttagtagagacggggtttctccatgttggtcaggctgctctcgaactcctgacctcaggtgatccaccgcctcggcctcccaaagcactgggattacaggcgtgagccaccgtgcccatcctacatttttttaaaaacacaaaattctggccagacatggtggctcacgcctgtaatcccagtgctttttttttttttttgagatggagtctcgctccgtcgcccaggctggagtgcagtggcgcgatctcggctcactgcaagctccgcctgccgggttcacgccattctcctgcctcagcctccggagcagctgggactacaggcgcccgccaccaggcccagctaattttttttgtatttttagtagagatggggtttcaccatgttagccaggatggtctcgatctcctgacctcgtgatccgcccgccttggcctcccaaagtgctgggattacaggcgtgtgccaccacgcctggcctaatcccagtgcttttggaggcctaggcaggagggtcacttgagcccaggagttagagaccggcctgggcaatatagtgagacccccatctcaaagcagaacaacagcagaacttctgagctagacagacaactttgctttgaatctgacaccagctttgggaaatacgctgtgcgcactgggccttggttgaccaaccttacaaattgagcagatttaatcagatggggtcaggaagtgctaattcagcacagtaaaaactcagcagatggaagctgcccactggggtctggggaatcttggggctgtggaagttagccagccttcgacattatgcactttgtacacatctgctcagaccgaaagaaggtccattttaaggctgggtgtgtactaagtaggtggaggaggaggaattatctgtgcctctttttcttttctttttttttttttttttttgagatggagtctcgctctgtcgcccaggctggagtgcagtggcgcaatctcggctcactgcaacctctgcctcccgggttcacgccattctcctgcctcagcctcccgagtagctgggactacaggcgcccgtcaccacgcccggctaatttttttttttttttgtatttttttttagtagagatggggtttcaccatgttagccaggatggtctcgatctcctgacctcatgatccgcccgcctcggcctgtcagagtgctgggattacaggcgtgatccaccgtgcccggccacctctggaagcagccagggccacacagtgcactagaatattcctcgctgatggcagaatattctgtgctgtccaacttggtcaccaccagccacgtgtggctctttggtgcttgaaatgtgatttgttcaactgagcaacttaaaatttaattttcttttctttttttttttttttttgagacatagtctcgctctgtcacccaagctggagtgcggtgactccatcataactcactgcaacctccacctcccaggcttaagcagtcctcccacctcagctccccgagtagctggaactacaggcatgccactacacccagctaacttttgtattttttgtagagacggggtctcgccatggtgcccagtctggtctggaactcctgggctcaagtgatcctcctgccttggctttccaaagtaccgagattacaggcatgtgccaccacgccccgcctaattttatttcagcgtagctaacttaaatgtaaaaagtcatatgtggctgtgacccttgtactgatggctgtagaacgtgaggagttttcaggagccaaatgatggaagaatggtcagcaggtggttgagaactattcccaggttttagagatgatttaaaatgagacggctggccgggcgtggtggctcacacctgtaatcccagcactttgggaggccgaggcaggaggatcacttgacgtcaggaattcaagaccggcctggctaacatggcaaaatcctgtctctactaaaaatgcaaaaattagccaggtgtggtggcaggagcctgtagtcccagctactcaggaggctgaggcagaagatttggttgaaaccaagagacggaagttgcagtgagccgagattgtgccactgcactccagcctgggcaacacggcaagattccatctaaataaataaatacataaatacataagatgaggcagccaaataaaaaggaaggagattctgaccaggctactcacatgggtgaaccttaaggacattaagctcaattgagaaaagccggacacagaaggacaaatactgcaagtccactcctaggaggtccctagagtcgtcagattcatagagacagaaagtaggttggcggggtcagggggtgtcggaggctggggaggggacggggagtgagtgtttcatggggacagagtttcagtttgggaagagtagaaagttctggagaggatggtggcgatggctgcatggccattggaatgtatttaatgtccctaaagctgtgcatggaaagttggttcaaatggtaaatattatgcatattttaccacaataagaaattaaattaaaaattaaaatgagatggcatagatttatagcatattatttttaaaactaaactaattttggccaggcatggtggtgctcacccatggttccaattactcgacagtctgaggtggggggattgctggagcccaggaggtccaggctgcagtgagccatgattgtgccactgcactgcagcctgggtgacagagcaagaccctgtctcaaaaacaaaattaggccgagcacagtggctcacacctgtaatcccagcactttgggaggctgaggcacgcggatcacttgaggtcagaagtttgagaccagcctggccaacttggtgaaaccccatctctactaaaaatacaaaaattagctgggctaattaaaattagattagaaaattagattacaggtggcacacacctgtaatctcagctacttaggaggctcaggcaggagaatcacttgaacccgggaggcagaggctgcagtgagctgagatcgcaccattgcactccagcctgggcgacacagcgatactctgttccaaaaaaaaaaaaaaatttaatttaattaaaaaacacataaattcctaggactataggaaaagaagaaaacttccttaacccaagaaagggaactacaaaaccccacagctaaccccgtacttagtggtgagaggctggatgttttctcccgagatcaggaacaagacaaggacaccactttccccatttctattgaacattgtactggaagttctgccagaccaataaggcaagaaaagaggctggacgtggtagctcacacctgtaatcccagcactttgagagaccaaagagagtggatcgcttgagcccaggagttccagaccagctagggcagcatcgcgaaaacccgtatctacaaataatacaaaaattagccagatgtggtggcgtgtacctggggccccagctacttgggaagctcagataggaggatggcttgagctcaggagttcaagactgcagtgagccgtgattgtgccaccttactccagcctaggtgacagagcaagatcctgtctcaaaaacgaagaagagaaagagatcagcctggctatcatggtgaaaccctatctctactaaaaatacaacaaaaattagctgggcgtgtgggcgtggtggcacgtgcctgtaatcccagctacttgggaggctgggaattgcttgagcccgggaggcggagattgcaatgagctggatcgtgccaccgcactccagtcctggcaacaagagaacaagagcgagattccatctcaaaaaaataaataaataaataaataaataaataaaagatacaaaataacaccatcaaagacagtaccaatagcgatattaatcaaatagcaatagtagtgaagctgccctctgcctggtgaagcactcactatggcagccatggttctgggagttttattaataattcattcatcacctttttttttttgagatggagtcactctgtcgcccagactagagtgcaattggcccgatctgggctcactgcaaaatccgcctcccgagttcaagagattctcctgcctcagcctcccaagtagctgggattacaggtgcccaccaccacgcccagctaatttttgtatttttagtggagacggggtttcaccatgtggggcagaatggtcttgaactcctgaccttaggtgatccacccacgttggcctcccatagtgctgggaatacaggcgtgagccaccgcgcccagccaatgtttcattcattaccatcttgtccctcataaacagcttccaagagggggtgctatagttgtgtccatttcacagatgagaagagtgaggcgcggatgcatccgaggccccgctccctggctgcccgattcgcaagctcatgctgggagccaccgtggggcctgacacttagtaggtgcccaagaaacattctcccttcccagggaaacacccggatgccagctgggcactgcggcctgctgagacgccagctgggcactgcagcctgctgagtctgtgtgggctctggttccggaagagggtcctgtgcccacggcctggcgcccggacggccggctgcccaggctgggtccttcccaacgtcatggccaccggtgcccagccttgagacagtccaaagggaactggccagctccgaggggccgctggcagccccagcctgggatcggctgcagggcttggggccgagctgggcacactcccctcggctgctgtccagcccagatggccacggccggggcagcctagctggaggaagggcttctctcgtctgctcctctgtttcctgacgaggaaactgaggcaccgggccctgctcctgtgctgttcatggcatccttggtcttggcaatcagtgggtgctggacacacggtgtgtgcatagccattagcacggcgccaggctaactccagaggctccgtgcgctaggaaatatcattgctttgatcattctcacagcaaccctgagaatggtctccatttatttttttaaaacaaggtcttgctctgtcactcaggctggagtgcagtggcatgatcacagctcactgcacccttgacctcccaggctcaagtgatcctcctgagtagctgggactacaggtgcctgctaccatgcctggctaatttttttttcttttttgttgagatggagttttgctcttgttgcccaggctggagtgcaataatggcgcgatcttggctcaccgcaacctccgcctccggggttcgagcgattctcctgcctcagcctcccgagtagctgggattacaggcatgcaccaccatgcccggctaattttgtatttttggtagagatggggtttcaccatgttgatcaggctggtctcaaactcctgagctcaaagtgatctgcccgcctcggcctcccaaagtgctgggattacaggagtgagccactgcacctggactgtttttttgtattttttgtaaaaacggggtctcactatgttgccctggctggtctcgaactcctggcctcaagcgatcctcccgcttcggcctcccaaagtgctgagattacaggcgtgagccactgtgccactgcccctggcttaatcatcatctcattttgcggatgaagaaactcaggccttgaaaggaaagtgaggccgggcgcggtggctcacgcctgtaatcccagcactttgggaggccgaggcgggcggatcaccaggtcaggagatcgagaccatcctggctaacacggtgaaaccccgtctctattaaaaattcaaaaaattagccgggcgtggtggcgggtgcctgtagtcccagctactcaggagactgaggcaggagaatggcgtgaacccaggagacggagcttgcagtgagccgagatcatgccactgcactccagcctgggcgacagagcgagactctgtctcaaaaaaaaaaggaaagtgaccttctcaggagcacaaagacccggggggtcttggagacagtacttggctcaggtgtctgatcccagcacaaaactgtagataaaataaccctggtgaaaaagcccatcacagggcctgggagggagaacattgctcgtggttctgacccgcagctttccttgtttatgaaatggatacagccaggcatggtggctcacgcttggcatcccagcactttgggaggccgaggcgggcggatcacctgaggtcaggagttcgagaccagcctgaccaacatggtgaaactcccgtctctactaaaaatacaaaaattagccaggcgtgatgacgcgcgcctgtaatctcagctactctggaggctgaagcgggagaatcacttgaacccgagaggtggaggttacagcaagccgcgatcgcaccactgcattccagcctgggagacagagtgagaccctgtctcaaaaaaataaaaataaataaataaaatagaagaaagtaataatggggcggactctcgtgattgaggtctccaaatgccctcaagtgcttcaggagtatcctctcctcactgcctcccagctctgctaaggcctgggcagtgtttgtgcccacgtggaagatgagaaacaggctcaggacagttaggcgacttgcctgaggtcacacagcgatcgcgtcctggccttggggtctggcgggtgggcaggaggggcgtgattctcttcctgcggctttcgacgttggttgctgccaccttcgtctttgacctgggtgatccatgggtggggctggggaggggcgtctgcctggctgggcttgtccacctgccccccaacttcagccctccgtggaggggtcagggctccagagggggcggatgtgactcgtcctgcatccaggctgccagagccgataacgctgagctcagcgtctgtctgcctgcgcgtctgccaaggaacctaattatttttagataagatggaggggcgggcgccggggcagagggagcacccaagctgggcgggcagtggggtcgtcgccatcagagagaccacccctcagcctcctctctctggggtccctgaacggcaacccaggactaacagccgggtccctgggactacaggggcagaggctgaggctaagggacgtgacgtctccaggactcacctctctggtcctcagtttccccatctgtaaaacggacatagtgatagacctcctgcatagggctaaggcggggctgaatgactgaacctcattttattttatttattttgttttatttattttattttatttattttgagacggagccttgctcttgtcgcccagactggagtgcagaggcatgatctccacttgctgcaacctctgcctcccgggttcaagcgattctcctgactcagcctcctgagtagctgggattccaggagcgtgccaccatgcccggctaatttttatatttttagtagagacggggttttgccatgttagccaggctggtcttcaactcctgacctcaagtgattttcctgccttggcctcccaaagtgctgggattacaggtgtgagccaccgtgcctggccgttttgttttatttttttgttgttgcttaatttcattttctgagatggggacttgctatgttgctcaggctggcctccaactccagtcgcccagactggactgcagtggtgcaatcctggctcactgcaacctccgcctccgaggctaaagcgattctcctgtctcagtctcccaagtagctgggattacaggtacgcatcaccacacctggctagtttttgtacttttagtagagatggggtttcaccatgttggccagtctggtctcaaactcctgaccctgacctcaggtgatctgcctcccttggcctcccaaagtgctaggattacaggcgtgagccaccgtgcccggcctgaacttcattttacagatgaggctcagagaaggcaagcgacttgctcagggtcgcacagcaagaaagcggcacagctgggatttgaacatcagtctgttaagattccaggtgtctaagttcttacccacgactgagccgcccctgcagaagcggagggcttacccaacatacgggtacactggcgctcacagggcctagctggtgtctgcagggtgcctggccagatgtctgtgaccctctagggcagcagccaagggaagggcccaaagagagaccccagggcctgggtgtgttttggggccactgtttgtctccatagcactggcccagcccaggactggggccaccagcatcgacacttcatctgctcctggggtggggtctctgtgatgccaccagtgtttcttccctctctttgcagatgcagagcaaagcggcagtccccggacagggatgggctctgaccaggaggacagcaagcccatcacgctgggtgagtctgggggcagcgtggcggtgaagggcggagggcgcagccctgtcctcgtcttttatttgggaatcatttgcttggcaccactcgttttacagatgagcagactgaggctcggagaggttaaggggcctgtccaggggctaccagggagctgggttggaacccacgactctgagctcccagcttctgggctctgaggtgctcaccccatgggagaccccagagggttctacggtcccatgggacgtttgagggtttttgtttgttttgttttgttttcattcatttatttattttgagatggagtctcgctctgtcatccaggctggagtgcagtggcacaatctcagctcactgcaagctccgcttcccgggttcaagtgattctcctgcctcagtctcccaagtagctgggattacaggtacctgccaccacacccggctaatttttgtatttttagtagagacggggtttcaccatgttggccaggtcggtcttgaactcctgacctcaggtgatccgcctacctcggcctcccaaagtgctgggattacaggcatgagccaccgtgcccggcctgtttgtttgtcttagaaacggtctcacgctgctgcccaggctggagtgcagtgacaccatcctagctcactgcagcctggaccagctaggctcaagcgatcctcctgccttagcctctcaagtagctgggactacaggtgtgcaccaccatgcctggcttttttttttttttttttttttttttttttttttgagatggagtatcactctgtcgcccaggctagagtgcagtggcgcgatctcggctcactgcatcctccatctcctgggttcaagcaactctcctgcctcagcctcctgagtagctgggattacaggtgtgtgccaccacggctggctaatttttgtatttttagtagagatggggtttcaccatgttggccaggctggtctcaaactcctgacctcgtgatccacccacctcggcctcccgaagtactgggattacaggcatgagccaccgcgcctggcttttttttttaattttttaaatatttttgtagagacagagtctcactatgttgctcagactggtctcaaactcctgagctcaagtgatcctcctgtcttggcttcccaaagcgctgggatcataggtgtgagccaccacacccagccctcatggggcgtctaatagatgggtaggacagtgtaattctatgttgtagggataggaagtgggaaaattaacctcacttagaccagagcagtcacttccatcctagcccccagctcctgcccttggcccccaccatttgtccttctcactatggccagaggacacctgtgagcccccaagtcagggcccgtccctcctctgcgcacagccatccacggctcccacctctcttggggtaaaagcccaggtcctccctgtggcccacaaggccctgcacaacctgtcccatccctgccctgtcctcccctcctccctctctccccgtcgtccactcccagccacacagacctcctcgccgttcctccagtgcaccagacccagtcctgcctcagggccgctgcacattctgttacctctgtctaaacagccaactaactgctcgcttgttctctccagatctcccctggtctcagctcaaatgcccccttctcagagaggtctaccctaaaccccttcagcataagcagcctctggctaccctcaatctttttttttttttttttttgagacagagtcaggctctgtcgcccaggctagagtgcaatggcgcaatctcggctcactgccatccccgcctcctaggttcacgccattctcctgcctcagcctcccgagtagctgggactacaggcgcccaccaccacacccgggtaattttttgtacttttagtagagatggggtttcaccgtggtagccaggatggtctcgatctcctgaccctgtgatgcacccgcctcggcctcccaaagtgctgggattacaggcatgagccaccgcgcccagcctggctaccctcagtctcagccctctgttttctttccttcagaggaagttagtgattgcctatggatttgcttagttgtttagtgactgcacgggtgtctgctcatctccccagtggaatgtcacctcctccagggcagaggctttgtctgtctacatctctgttgtgccctcagggcttagaatggggcctgatgcagagtgggtgctcaataaatacttgtagaaagaaaagaaggagagagggagggatgaagcagagagaagaagacaagagaggatatatggggagaggaaggaggagagatgaaaaagaaggaaggggccaagtgcggtggctcacgcctgtaatcccagcactttgggaggccaaggcaggtggatcacctgaggtcaggagttcgagaccagcctgaccaacatggtgaaaccgtctctactaaaaatacaaaaattagtcgggcatgttggcacacacctataatcccagctagtcgggaggctgaggcaggagaatcgcttgaacccaggaggcagaggttgtggtgagccgagattgtgcaccctgggcgacacagcgagactctgtcaaaaaaaaaaaaaaaaaagaagaagaagaaagaaggaaagaaagaaagaaaagaaagagagagagaaaaagaagggccgggtgcgggggcttacgcctgtaatcccagcactttgggggactgaggtgggtggatcacctgaggtcaggagtttgagactagcctgatcaacatggagaaaccctgtctctactgaatatacaaaaattagccaggcgtggaggcacatgcctgtaatcccagctacccgagaggctgaggcaggagaattgcttgaacccgggagacagaggttgcagtgagctgagatcgcgccattgcactctagcctgggcaacaagagtaaaaactccgtctcaaaaaaaaaaaaaagaaaagaaaagaaaaagaaggaaggggccagggcgcagtggcttacacctgtaatcccagtactttgggaggccgagtcaggtggatgacctgaggtcaggagttcaagaccagcctggccaacatggcgaaaccccatctgtactaggaggacacgggaggctgacgcaggagaattgcttgaacccaggaggaggcggaggttgcagtgagccgagatcacgccactgcactccagcctgggggatagagtgagactgtctcaaaaaaaaaaaaggaaaggaaaagaaggaaggaagagaaagcgagtgggtgaggcgtccttcttggaaggaccggaacaggcatgcacagggaggctggaaggttctcggaggttcacaggcctgaggccactcctcactggcccccggtgactcctccgtctgtgacccgggtcctccgcggcctcctgtgatccccagacgcctctctccaagccagatgttggagggaggtgggggcagcggcgcttggcctggtcccctggggagcttgggcgtctggtagaggaaatcacgtcctcccagctcgccagggagtcccccagagatggagctgagcaggcgctgcacaaacaggaaaccccggtcgggggaggcggagggggcgtgctgacaccagctggccagctgggtcagcaggaaacggctctggccacttctcctggacactcgggggccaccgctctgtcctcttcagaatgcgtggccctgaacctcccagcgcggggcagggttggttcattgccttcactcagcaaatgactgtaacagggggccgggtgcggtggctcacgcctgcaatcccagcactttgggaggctgaagcgggaggatcgcttgagcccaggagttcaagaccagcctgggtaatatagcaagaccctatctctacccaaaaaaaaaatatacacacacacacacacacacacacacacacacacacactagccccaggagttcaagaccagcctgggtaatatagcaagaccctatctctaccccaaaaaaaaaaaaaaaaatatatacacacacacacacacacacacacacacacacacacacacactagccaaacacggaggtgcatgcctgtaatcccagctacttgggaggctgaggtgggaggatcgcctgagcccaggagtttgagaccagcctgggtaacatagcaagaccctatctctacaaaaagtaataataataatacaaaaattagccaagggtggtgatgcgtgcctgtagtcccagctacttgggaggctgaggcaggagcatcacttcagcccaggagttcgaggctgcagtgagctatgattgcaccgctgcactcgagcctgggcaacagagcaaaattctgtctctaaaaaagaaagattgtaacagggggactggcgggggtttgggtctgcagaactggacacagccctgagctccctgcagtccgtgctgccccctgggggccgggagaggaactgctcccaccgccacccaaaagccaagagcctgtcccacctccaaacctaccaggctccctggctctttccactccaaccctgctggcctgcaacttgccaagtgcatttctacccggaggcctttgcacgggctgttcccagtgccgggaacatcgtggccctcagggaggtgatgaaacatcatccccatcggagaagccaacagtcacggggcggttgccaggcgctgttctcggagctttgcagattttaacaagttccttcctcttatccagtctcatcttgaggtctgtaaaatgccaccatctcggtcaggctttctctgagccctgggtgtaaaatagcctccctccccaccctagctagttccccaccagccgcctgccttaccacaggctgatgcacctcgcatttgacttaatgagcttttaatttgtagtaaaatgtgcatgatgtacaatgcatcattttagccatttttaagtgtccaagtcaaagtgcactaagtacattcacctctatctaattccagaacctttctttttttttttttttacccccaggctggagtgcagtggcgcaatctcggctcactgcaacctccaccttcctggttcaagcaattctcatggctcagcctcccaagtagctgggatcataggcacatgccaccacacccggctaattttttgtattttcagtagagatggagtttcaccatgttggccaggctggtctcgaactcttgaccttaagtgattctcttgcctcagccttccaaagtgctgggattacagatgtgagccgccgagcctggcctaattccagaacatttcatcccccctaaaagaaaccccatccccatcagccaccactccctgtctcctctcccagccctggtgcccacgcatccccttcttgtctctgtggcttggcctgtcctggacatttcagtgaaatggctcatgcctgtaatcccagcactttgggaggccaaggtgggtggatcatgtggtcaggagttcgagaccagccggaccaagatggtgaaaccccgtctctattaaaaatccaaaatttagacaggcactgtggcaggtacttgtaatcccagctacttgggaggctgagacaggagaatcgcttgaacctgggaggcataggttgcagtgagccaagattgcgccactgcactccagcctgggcgacagagtgagactccgtctcaaaaaaaaaaaaaaagaaaagaaaaagaaagaaagaaatggcatcacacactgtgtggccttttgtctctggtgtccctcactgaatgatgtcctcaaggtgcatccatgttgtagcctgtgtcagagcctcgttcttttatttttatttatttactggttttgagatgaagtctcactctgatgcccaggctggagtgcaatgtcgcgatctcggcctgtagctgggactacaggtgcccgccaccatgcccggctaatttttgtatttttagtagagatggggtttcaccatgttggccaggctggtcttgaacccctgagctcaggtgatccacctgcctcagcctcccaaagtgctgggattacaggtgtgagctaccactactgcgcccagcccaaggcctcattctttttcttttccttcttcttttttttttttttttttttttttttgagacagggtcttgctctgtccccgaggctggagtgcagtggtgcaatcatagctcactgcagcctcaacctccagggctcgagctatcctcccgcctcggcctcccaagtagctgggactacaggtgtgcaccaccacgcccagctaatttttgtactttttgtagggatggggtttcgccatgttgcccagtcccgtctcaaactctggggctcaagtgatccacctgcctcagcttcccaaagtgctgggactataggcacaagccaccatacccagctaattttcgtattttttgtagacacagggtttcgccatgttgcccgggctgatctcaaactcctgagctcacgagatccacccacctcagcttcccaaagtgccgggattacaggcatgagccaccacgcccggcatccttttcacggctgagtcctattccagtgtgtggctagaccacgctgtgtttatctcttcatcttttgaagggacatttgggtggctttccagtttgagctgtggtgaacagtgctgctaggaacattcgtggacttttgctgacctattaatcttggctgctgtctgtcgctcacactggactttgagtctcacaggggcaactgcttcagcctgtatcatctcctgctgtgccggggcccagctcagaatcagacactgtggatgcttagtaaacgcctgttgagtccatgaatccctcctacaagggcgtccgagggcaggacagggctgtccccaagctgtctgaggttggccaaggctcccgacctctcggggacaacttcgatttccaaatctgtgaaatgggtccaaaccactccagtcgagaggacagtctcccttcctttaatattaggtaggagcaatgctggggacactgagggttttaactgcggcttgtgggcctcccattcaaccccccattttaactgacccattgctgggtgccaagctctggtctaggcacgaaggacactgcagggtcggggcagacagacatccctgcccacacggacctcccagtctgaaggggagaagaacaagaagccagagtatctcgaagggtgacagtgtgtaaagcaagccagctgcccctcccaggcagttggatacagatctcacgacaaccccgatgatgggattgatggtttcacttttgcaattagggaaacttggaggctgagagagggaaagtgacctgccccagatcacacaccgaggcaggtgatggagccgatgtgagcccaggcctccgctttccgctcttttttttttttttttttgagatggagtcttgctctgttgcccaggctggatggagtgcagtggcgcaatctcggctcactgcaagctccacctctcgggttcacaccattctcctgcctcagcctcccaggtagctgggactacaggcgcctgccaccacgcccggctaatttttgtatttttaggagacagggtttcactgtgttagccaggatggtctccatctcctgacctgtgatcctcccgcctcggcctcccaaagtgctgggattacagacgtgagccaccgcacccggctccactcgttttttaagagagggtgtcgccctgtttcccaggctggagtgcagtggcacaacaatggttcattgcggcctccacctcccaggctcaagtgatcctccagcctcagcctcctgagtagctgggactacaggcacggaccacaacacctggctaattttaacactttttgtagagatggggtctcgctgtgttccccaggctggtcttgaagtcctgagctcaagcgttcctcctgcctcggcctcccacagtgctgggattacaggcatgagccactgcgcccggcctgctgttcacttgaatgcagcattccacagcatgggggaacccggatgaaggctgtgtgaaggcccacactggacaaggaccccccacggggccttccccatcagactggagctgtcattcccccacagcacaggatggacagggggaacgtccaggctcgggccagcccccaggagtccaggcagccctggagtgtggggaagggaaacaggcccagctcagcctactgaccccgctgtcttcctgttccagacacgaccgacttccaggagagctttgtcacctccggcgtgttcagcgtcactgagctcatccaagtgtcccggagtgagtgttcccgtcagccctgagctgggtcttggagaggggagggggccgcagggaggaaggagcccacccccctcaccctactccttgtcctttccagacaaccccctgtgtcactaagccaaggttcctagaaagggaggtggccaggcccttcccagagcccaaggtcagggctccctcccacctctccaggaaacagaatctaaatgctggatggcaactaaggaaacttctgccccagcatccctcctcctccctggggcctccactgtcctgtcccaggagaccccaaaggaccccgcccctcctgtccccttgctttctctgctgacctgctggggacccagcacattccgtcacacactgtctgaatcccaccccagcgagtcctgggcgctgtccttctttagccctgactgacaccttccctgtccagatcagcagagcctggcctccagctttggctacacctctgcctcacagtgtgctcttggcctctccccatggccttggtcctctgatccatagaataaaactggtttcagccaccctaggaaccgggccaatatgggaagggggtccccctttggactgcacccagtggctttccctacctctctaaagcaaaccgcagcactgggcactgcttcctgcctcactctcctctgtcaccctctgcagcacccgtggtgactggaacaggacccaacttctccctgggggagctgcaggggcacctggcatacgacctgaacccagccagcactggcctcagaagaacgctgcccagcacctcctccagtgggtaagtacccaggtccccacctctgggcatttcatgaccccattcatcaacccatcccctctggcccgagctgactcattcctctccctggaatacctcttttcacgattcacctggcctgagaaactcctactcatctcatccttcaaaacccagccagccccacgtgcctcttcccctagccctgacagcccaccgtgggctcccccagcctcaagtcctgccggctcagccagcccttaggaccctccccacccagaagaatgcagacacaggttgttgctgagatatgctttgtgacctcgagcaggtcacactgtgtgtgccccagtttccccatccataaaatgggatcatacccctaacaggcagttctgaggactacaggtggccaggagattagccaggctgcctgggttttggtctccaccatgctagcttggtgtccgacctgtgttgagaccctccctgcctctggcccgggtgtcccatccaagcaatggacaggttggaacaggcgttcgtagggaacgggctgaacgcccgcggctcccgcgatgtctcgcgatactacctccctcgcccccgctcacttaaggaccggaagtagcaaagcccgccgtcgcgccccccgccccgcgtctccctggtaaccagcctctccccttccctcgcccataaggagcaagcggcacaaatcgggctcgatggaggaagacgtggacacgagccctggcggcgattactacacttcgcccagctcgcccacgagtagcagccgcaactggacggaggacatggaaggaggtagggctggtggcgggggcggagccggccttccggtctgagtcaccgtggcgggaactacgtcttccggcagccactgcgcgggcgccgcggggcaggaagccggcctggagccgcggggcctcctgggaattgtagtcgtcccgagctgcgcttggctggaagtacggtccgggttcgcgttctcggatctctttggttccgctgcggcgaaggagggcagagactgtcccctgcctgactctcctgccctccggccgtgaatgccacatctctgtggggtccccgagctgcaggatggactcagtagtgactctgatcaacagggcgcctcttcctgggatctgtcatagaatccctcgtctgtagggaccctgtttgtcctcttcccctctagaaggtcctgagatgccggatcccttctcattggggtccttcttgaggttacttttttttttaaccaggttcccatctccatgggatcttctggttctgcaggagactcgtctcctttctgtagggtctccattcccatggcgtcgttttctaggaagattttatcctcttgcttttctgtcttcagaagggtcctctctggggtgtctttctttctttctttctttctttcttttttttgagatggagtttcgctcttgttgcccaggctggagtgcaatggcgcgatctccgctcactgcagcctccacctccctggttcaagcaattgtcctacctcagcctcccaagtaactgggattacaggcatgcaccaccatgcccggctaattttttctatttttagtacagacggggtttcaccatgttggtcaggctggtctcaaactcccgacctcaggtgattcgcccgcctcggcctcccaaagttctgggattacaggcgtgagccaccacgcccggcctctgtttttgtttgtttgtttgtttgtttgtttttgaaacggagtctcggtctgctgcccaggctggagtgccggggtgcaatcttggctcactgcagcctcgacctcccaggttcaagtgatcctcctgcctcagcctcccaagtatcggactgcaggtgcatactgccatgcgccgttaattttttttttttttttttttttttttttggtagagatggggtctcactatgttgcctaagctggtcttgaactcctgagttcaagtgtgatctttcctcctgcctcgtcctcccaaagtgctgggattccaggtgtgagccaccatgccgggcccctcttatttttttttaatttttgttttttgagatggagtcttgctctgtcacccaggctggagtgcagtggcgagatcttggctcactgcaacccttcctcctgagttcaagcaattctcctgcctcagcctcccaagtagctgggattacaggcacccaccaccacacccggctaatctttatatttttagtagagacagtgtttcaccatgttggccagtctggtctcaaactcctgacctcaggtgatccacccacctcggcctcccaaagtgctgggatgacaggtgtgagccactgctcccggccacctgtaggatttttagaagcagtataacattaggattaagaggtcagattcaggcattggagagacctgggttcagatcccagccctgcccgtgtctagctctgtgtgctgtgtaacctggggcacatcacttaacttctctaagcctcagtttcttcatctccacaatgggggtgatgtgaataatgttctttgggagctacaggaggaggaagggtaggatgtgcgtgaagcaaccgtctggcccatgcgacatacccgggaaacgggaggtcactgtcatccacgtctttataacattcctgtctctgaccaggctcggtggctcacgcctgtaatcccagcactttgggaggccgaggcaggcggatcacgaggtcaggagatcgagaccatcccggctaacacagtgaaaccccgtctctactaaaaatacaaaaaaaatagccgggcgtggcggcgggtgcctgtagtcccagctactcaggaggctgaggcaggagaatggcatgaacccgggaggcggagcttgcagtgagctgagatggcgccactgcactccagcctgggtgacagagcgagactccgtctcaaaaaaaaaaaaaaattcctgtctctttccggcactcggacgcatctagttgtgacatttcaggtgccaaggcccctcccttccacagtgtgggctcccagagcaggaacattcctaaagggtctccatccctcaggggacctgtctcagtatttatgaggttctttttttgtttgtttgttgtttttgttttgagatggagtcttgcttgttttgagagatcacgccagtgcacgccagcctgggcaacagaacgagactatgtctcaaaaaaaaaaaaagaaaaaaaaagtcacttctgtttcgttttttttgttttttgttttttgttttttttttgagacggagtttcgctcttatcacccaggctggagtgcagtggtgcaatctcggctccacctcctgggttcaagtgattctcctgcctcagcctcccgagtagctgggactacaggcgggcaccaccacaaccagctaatttttgtatttttagtagagacggtttttactatgttggccaggctggtcttgaactcctgacctcaagtgatccgccaacctcaagtgatccgcccatctcagcctcccaaagtgctggcattacaggtgtgagccaccgcacccagccgtgacttctcattaactctgtaattgatgaggctgtcagaatgtaaactgcacgctaattaaagtgaaagaccacctttgcgatgagccaaagcaaccctgagaggaaaaattgtagctttaagtctatttattaggagaggagaaaggtggaaaataaagaatctagctttcaacagagaaaactcaaaaagaaaacattttaagctctggagctcagtctgacttttctgcccggctgctcactggcaaccccttccactggggaaggaggtggtagcaatggggggaggacaaagaggaagcccccaccagcttctgctctgtgattgggaatcgcagagctagcagggaatgtcagaggaggtctgtgctcctgcagcttccacttgattacctcaggggatggcaaactcactccctcctgagggtttcttttttttttttttttttttctttttgagacagagtctcgctctgtcgcccaggctggagtgcagtggcgccatctcagctcactgcaagctccgcttcccgggttcacgccattctcctgcctcagcctcccgagtagctgggactacaggcacccactaccacgcccggctaattttttctattttcagtagagacggggtttcaccgtgttagccaggatggtctcgatctcctgacctcgtgatccgcccatctcggcctcccaaagtgctgggattacaggcgtgagccaccgcacccggcctcctcctgagggtttcatcctcagtgtaaagccctcctgtgtgctggccctacctgaggccctggggacacagagatgatccaacccactcttgtccctaccttccaggggctaacagcctagtgagggagatgggtttttatccaggtgactacagcccagaggaggaggcacagaagacagtcagggggaacaagaggaccctgatagaacttggaagaaaagggaggacctccccgaggaggagaatcaggctgacagagcagtgaggagctcgggcaactggcttctctgcttctccagctgtgtgacatttggcaggttccttaacctctctgcccctcaatttcctctgctatacgatcaggttgctggccgggtgcagtggcttacaactgtaatcctagcaatatggcaagaccccatctctacttaaaaaaaaaaaaaaaatagcatcacatagtggtgtacacctgtagtcccagctccttgggaggctgaggtgagaggattgcttaagacgggaggtcaaagctgccctgagctatgatcataccactgcactccatccggggcaacagagaaagaccctgtctcaaaaaaaaaaaaaaaaaaaaaaaaaaaaaaaaaaaaaaaaaaggctcacctgtaatcccagcactttgggaggccgaggcaggcggatcacctgaggtcaggagttcgagaccagcctggccaacagggtgaaaccccatcattactaaaaacacaaaattagccgggtgtggtggtgggcacctgtaatcccagctactcgggaggctgaggcaggagaatcacttgaacctgggaggcggagggtgcagtgagccgagattgtgccattacactccagcctgggcaacaagagcgaaactccatctcaaaaaactctgccttgatatcccagtgaagagaaaacactggaagaatttttttttttttttttttgtcagagtcttgctctgtcgcccaggctggagtgcagtggtgtgatctcggctcactgcaagctccgcctcccgggttcatgccattctcctgcctcagcctcccgaatagctgggactacaggcacccaccaccatgcccggctaattttttgtatttttagtagagacggggtttcaccgtgttagccaggatggtctcgatctcctgacttcgtgatctgcccgcctcggcctcccaaagtgctgggattacaggcgtgagccaccgcgcccggccaaacactggaagaattttaacacccgtggcccagggctggactttacgtaaagcacgcacctggggcgtgagagccgggtttattattaattcgcggctaagctacaaccgggatgatttaagtggatttatccgcagggaagatgatgggagggcattcccagcagggagaatcgtggtttgaggagttgcactgtggatgtttggggccagaccatcctctggggcggggctgtcttgggcactgttgggtgctgtgcagagttcatggcctccacccactccgtgtcaggagcaccccccagtggtgacaaccgtaaatgtccccagacctggccaaatgtctcttgcgggcagaatctcccctataatatagccagaggcatatgcaaagcacctaaacggagtggggagaaggtgcgtgacccctggtctgggccactcttttttttttttttgagacggaatctctctctgtcgctcgcccaggctggggtgcaatgcgcgatcttgactcactgcaagctctgcctcccaggttcaagcgattctcgtgcctcagcctcccgaatagctaggattacaggtgcccgccaccacggctggctaatttttgtatttttagcggaggcgggttttcaccatgttggccagtctggtctggaactcctgacctcaggagttccaccacacccggctaattttgtgtttttagtaatgatggggtttcaccctgttggccaggctgctctcgaactcctgacctcaggtgatccgcccgcctcggcctcccaaagtgctgggattacaggcgtgagccactgcgcctggccttttttgttttgttttgttttgtttttcccaaatagtgacttgctctgtcgcccaggatggagtgcagtggtgcgatcagcgcccactgggctcatgccatcctccttcctcagcctcccaagtagctgggactatgggcacttgccaacacacctggctattttttgtactttttgtagagacagagttccctgtgttgcccaggctggtcttaaactcctgggctcatcctcctgcctctgcttcccacagtgttgggatggcaggtgtgagccaccacacccggctggccgctttttctctatgtcccttcccaacattttagtcccagacagccctgcggaggtgcctggcaggcacctcattttgcagagggaaaccctgaggctcaaagaggtgacatcacctgctccaggtcaccccagcggcaagcgggtgcacagggacacggaaccacgtggccgttcccagcggccccactcagggtacctcgctctctttgttttatggggcatctgtgatgtcctaagccgggttatttcccctcccggcaacactctgtgagatcagggctgcccctggccatcagttgacaagtggggaaactgaggcccaaaggtcccacagcaaagaaggggcagagccccgagcttatgcccagtgcttcctgggcctctccccatcgctgtggcctgcatcggtaaacatttcgcagcctctgaagtcccaagggggacgcctcagaacaggcctggcccctgggctggagcagggttcctgaggttcccagtggggcccagctgtaacctcattggtggaccgaggcaagggccagaggggcccaagggaagggccagaggggccgggggcacaggaagggccggaggggctgggggcacggggagggccaggcttattgttgcagcctgcaaggctgtcccaagccgggtgcctccgcagagggaggacacaaaacaggaacccaggcaggcagggtctctcccgaaggtgcccttggcccctggccaccaccctgggatgctcctcctcctcctcggcatcctccccccacccttccctgccctttccagcttcctgtctagacagcccccaattagccactcattaagggggttaagctgattagagcagctctcccttcctctggcggactcggggccttttctcccgggcagtgctcagccagtccccaaccctgaggctcacagaggcctggggggatcatgccagcccgatgccaggcaagacccccaccccacacctccaggccccacattccagcctctaggctttgcccgcttggggcctgggccaggccctttctcctggccgcctccacccgaggcctccctgcttacgcggctgcgtggggtggagggaaggtgccttggagcagcccccactgtgctttgtttttgctgcttgtgtagctcccccttgaaggcgacaaaggtcccgtccacaggcggttattacacagggcggggcaggcagcccccatccattcctctcctctgtcaccccaggcttcccatcccttttttttttttttttttgagtcagaatctcactctgttgcccaggctggagtgcagtggcatgatctcggctcactgcagcctctgccttccagattcaagcaattcttctgcttcagcctcgcaaatagctgggactgggactacaggcgcctgccaccatgaccagctaatttgtgtatttttagtagagatggagtttcaccatgttggccaggctggtctcaaactcctgacctcaagtgatccgcccgcctcggcctcccacagtgctaggatgacaggtgtgagccaccgagcccagcccgcccatccctttttttaaccccagggtggaggctagtgcaacgtggcctggggagggacagagttgggttccaactccacctccacccccccttggctctatggccttaggcgagtgacgtcccccatcaggcctcagcctccacatctgtgaaatgggcgcagctcctgtaagctctgcacggggcagctgtgaggaccacattaagagaggaggctagtgccttcacagaaggtcctcacccagggcgatgctgccccacccccagggacactggccggtgtctagggacatctgtggttgtcacaactgggagagctcttgacatggagtgggtcgaggccagggatgctgcttagcaccctgcagtgcccaggacagcccctccccagggaacgagccagccccaatgtctacagtgctgaggctgagaaacctgtattaattatgtagaaaaaaattgaggctgagtgtggtggctcacacctgtaatcccagcactttgggaggccaaggctggaggatcgcttgagcctagtagtttgataacatagggaaaccctgtctctacaaaaaaataccaaattagctgcatgtggtggcgtgtgcctgtagtcccagctactcgagaggctgaggttgggaggatcgcttgagcccaggaggtcaaggctgcagtaagctatgattgcaccagtgcactccagtctgggcaacagcgtgagaccctatctcaaaaaaaaaaaaagaaaaagaaaaaagtctgccccctgctcacaacggaataaactcctagtgtggcagacggtgtgtaaaccagggggacccccagctcctgggactcacctcctctctccctccccactcaaggtgtggatttcaatgtgtgcagcctcctgggacctctgcagggcagaggatcatgggacgcagaggatcatgggacgcagagtctcttgggggtccatggaatcctctaagacagaggattttacctatgggtgatcctgaccccagaggacactgggtgacatctggggacctgtgtggttgtcacgactgcagggtggtcctggcatggattgggtccagggacaccgcttagcaccctgcagtgctcaggatggccccaccctagagaatgatccggtcccaaatgtccacagggcccagaggagaccttggtgcactgtcaacgccccgtggtcactgctgtcctcatcagattcatgccctgcatcggggcctctgtccactccacacactctgtgtagggcccctcctgaccccggaccctagagacccagccagagtgggccttggccccctgggggagccggcatttcagtgggagatgggcttgtttgttgagcaaacaaatggctgctccgacggggtgatgagggccttttgtcaaatacaaagaggaggtcagatgggcgtgtgtgacaaatggctgctccgacggggtgatgagggccttttgtcaaatagaggaggtcagatgggcgtgtgtgacaaatggctgctccgtcggggtgatgagggccttttgtcaaatacagagaggaggtcagatgggcgtgtgtgttaaacagacaggaagaagctctgatgggggagccctcgggcctgcgtcctcctcacagtcaatattctcagatggggcattcaggatgccgggagtggcgtatggatgtgttccctgagaggaaagatggccactgagatgggcgggggacgcacatgcccgctggctgaacagggaggtcccacaggggtcccaggcatgcctgctgaacagacagaggatgcttggaggcggggtgcagagtcagtgtccgtagagcctgccgggagcgtgccggcttattctttctcgcggtgcctgagctgcgctcccccctccttcctgccctgccctggctgccgctggccccatctcaggaagctctagcggtgcctgcagggatgtggcggccgggggtggagtctgagccagactatttccatccaggacaagcggttctaggaaatcctcctaaatgagcgtctgacaaccctaacctcgttcccgccgtggccctgcgcttgcagggagctgccagcccctgcacacacacacacacgcttgcacacacgcatgcatgctcatacatatatgcacgcacgtgcacaggcgtgcacacatgtatgcatgcatgcttgcagacctgtacgtgtgcgtgcaagcacacatacatagacatgaacatgcatgtgcaggcatacacatacatgcatatattcacgtgcacacgcatgtgcgcattcacacacatagacacgtgcacaggcatacacatacacagatatgaacgtgcatgtacaggcatacatatgcaggcgtgcacacgtccacatatgctcacatgcgtacacacacatgcacagacatgcacacatgcatgcagctgtgcacatgcgtgcaggcatacacacatacatgcacgcacacacatgcatgtattcacatgcacacacacacgtgcacaggcatacacatgcacacacacgtgccgacaagaccagcctggcctccccggctccaggccaccctcattcctgccacatcctcctgccctggaaaagcccgggcctggctgctggggcccagcttggtcacagacttcatggcatcccactgggcagtggggcctctctgggtggctcagcctcgatgtccgaggcctcaggagtgttcccccttgagtgttcacaggctgggcatgagtggaggtgtcatccttcctgccccccatgtgggtgtcctgggtgcccgcctcctccagagccgggtgttcccgggtccctgggaactgctgacctgcttctggggtgtgtcccagtgacaccttcactcctcacagcatggtgtgtgcagggccatggggacagctggttccataaccacaaaagcagatgaagagctgcatgtccccccacagctgggtcctggatctgggctccccctgggctgcagccatcagagaggacggaagttccctgagtggtaaccccgttcagggaaggatgcagcgatgctgggaggatggaggaggtggggacaggactggggagggcctgtaccacacagatgcctgcaggtgcctatggaaccaccagcaggagacccaagacacggtgacatcctcaccgtttctcatcagggcatcacccggggacagcaggtcacatctggggacatccgtggttgtccccactgaggggcgctcttggcacggagtgggtggaggccaggggtgctgctcagcgccctgcagtgcccaggacagctccctacagagaccgatctggcccccacatcagcagtgctgagactgagaaatcctgcgtgaattatttggaaaatattgagttacgtcactgctcacaccagacaccagaagaagctcctgacagggcagacggtagaaaccagggggaccccagctcctgggattcacctcctctctccctcctcactccgtgtggatttcagtgtgtgcagcctcctgggaccacagcagggcagaggatcatgggacatagtctcgtggagggtccatgggatcccctaacccagagggtctcacccacacgtgattcttgcccagggtacttttggtgatgtctggggacatctgtggttgttacaaccgggggtgctcctggcatgaagtgggtggtggccagggactctgctcagcaccctgcagtgcccaggagggccccaccccagagaatgatccagccccagtgtccacagtgcctgtctgagagaccctggaggtaaggaactccaagggccaggtcgaagggaagctaaactcatcaccctgtttggatggtctcagtagatatgttttaccttaaaagaaatgtaaaaatcctttctaaaaattcggctccccagggcacgcctccctgagattccatttccagggatagggtagggcccaggacactgcatttctcaggcaagatgtgatccttagccctcacttgaaaaagcttctctggggccaggcactgtggctcacgcctgtaatcccagcactttgagagaccaaggcaagaggatcccttgagcccaggagtttgagaccagcctgggcaacatagcaagaccccatctctaaaaaaaaaattgcctggacatgatggtgcatgcctgtggtcccacctacctgggaggctgaggtgggaggatcacttaagcccaggaggttgaggctgcagtgagccatgatcgtgcctctgcactctagcctgggtgacaaataactcggctgggtgcagtggctcacgcctataatcccagcactttgggaggccgaggtgggtggatcacctgaggccaggagtttgagaccagcctggccaacatggtgaaaccccatctctactaaaaatacaaaaatgacccgggcgtggtggtgggcgcctgtaatcccagctactcgggaggctgaggcagtagaatcgcttgaacctgggaggcggaggttgcagcgagccgagatcacgccattgcactccagccagggcgacagagggagactctatctcaaaaaaaaaaaaaaaaaaaagacacagccccagaaggccaggcatttcggctccagagctgggactccaccccagcctcctggaaatacccaaaatggccctctttggggctctgtgttcccacttcattttgaagacagggtgaaagtgtcaaggggcaccgtgtcatctccccactcaccccaaatagcagcagcagcggctcctgcagtagctaacattcttccagctgggtggctgacgttccctcggaaagcagggctgaaggcatcctcagagaatgccccgatgcccagggatctgggacggccatgggcttcacctgcacaggcacccctggcccaatcctcacagctgccactcccacactgctcccgatggaaattccagagctttacagaatcccctgttttatgaaaaggggtagacgtggcagctcaccccaggtcgcacagcctcatggccagccggggtttgaaccctggaccacctgcttcccccacacccaggggctttccagggggtgcctggagggggagggaagccgatgtttggtgggtgagcctccctgagtccatccgttttttgtttgtttgtttacttgcttgtttgtttttgagacagtttcacagtttcattcttgttgcctgggctggagtgcaatggcgtgatctcggcccactgcaacctctgccgcctgggttcaagcgattctcctgcctcagcctcccaagtagctgggattacaggcgtgagcccctgcacccgactatccatctgttttttgtgtttgtgatggagtcttgctctgtagccctggctggagtgtagtggcgtgatctcagctcactgcaacctctgcctcctgggttcaagcgattctcctgcctcagcctcccaagtagctgggattacaggcacccgccaccacacccacctaatttttgtatttttagtggagacagggtttcaccatgttggccaggctggtcttgaactcctggcctcaagtgatctgcccacctcagcctcccaaagcactgggattacaggcatgagccactgtgcctggcctctgtttcttcattcattgattcactgaggaaggtgtgaggggctgagctgctgagttgggggctgtgggggcttttgtcccaggcagcctgggaggtagtgaggcccctgtctgcagagtgatgccagcaagtcactgcagaggggggatgcacctcatttcagccccagggaggctccgttccttcctcccgcgtggacgagggaaggcagagctgagctggggcttgtctgtgcgcccttagccagtcagggtctaactggacttcggatctgactgtctctgccctccctgccaccttctctagggctcgggtgactcccaggtgatggggcagccctgagccttcccatttctctggaaggagagtaggcaagggccaggagcgaggcccaggggcacgtgttgatacccagctctccatcccccggctgtgccgccctggctagccccttctctgctctgagccttcgtttactcctctgtgtaatgggctcacagcctctccccctcaggattctggggtaagaggaggcggggtgatgaggcttcctatcccttcggaggctggctttggggaaggtccagggctcatggggtgtgaccagcctgtgactctctcgtcccatcccctccacaggcatctcgtccccggtgaagaagacagagatggacaagtcaccattcaacagcccgtccccccaggactctccccgcctctccagcttcacccagcaccaccggcccgtcatcgccgtgcacagcggtaagcgccacgggcccctggcggggaggggcggcgggccctcctatcaggcctctcacagccggggaagtcccactggatgtctgaccatgagtcctattgctgtagccttctaggtgggcaaaaaaccatagaggtgccgtagtggagagcgcccagggccttgttccagcccggctgagaggttggactcagtccctttgggcctcagtttcccccctgtataacaaaaggctgcaacctaacttcacctcactcccctcacccccgtctcaatctaatccccccattccaaccccagacactgatggacaggcaggatcagaagctgccaatgaggccaggcacagtggctcacacctgtaatcccggcactttgggaggctgaggcgggtggatcatctgaggtcaggagtttgagaccagcctggccaacatggtgaaaccccatctctactaaaaatacaaaaattagccaggcgtggtggcacgcacctgtagtcccagctactggggaggctgaggcaggagaattgcttgaacccgggaggtagaagttgcagtgagcagagatcacaccactgcactccagcctgggcaacagagtaagattccatctcaaaaaaaaaaaaaaaagctaggcttggtggctcatgcctgtaattctagcactttgagaggccgaggcaggcagatcacaaggtcaggagttcaagaccagcctggccaacatggtgaaaccccttgtctactaaaaatacaaaaattagccgagtgtggtggtatgcgcctgtagtcccagctacttgggaggctgaggcaggagaatcgcttgaacccaggaggcagaggttgcggtgaggcgagttcacgccattgcactccaacctgggcgacagagcaagaccctgtctccaaaaaaaggctaagtgcaagtggctcacgcctgtaatcccagcactttgggatttcaaggcgggcggattacgaggtcaggagattgagaccatcctggctaacatggtgaaaccccgtctctactaaaaatacaaaaaattatccgggcgtggtggcaggcgcctgtagtcccagctacttgggaggctgaggcaggagaatggcgtgaacccgggaggcggagcttgcagtgagccaagatcgtgccagtgcactccagcctgggtgacagagcgagactccatctcaaaaaaaaaaaaagagacatctccatctcggccaggcacagtggttcacacctgtaatcccagcactttgggaggccgaggcaggcggatcacctgaggtcaggagttcaagaccagcctggacaacatggtgaaatctcgtttctactaaaatacaaaaattagctcggtgtggtgatgcatgcctgtgatcccagctactcaggaggctgaggcacaagaatttcttgaacccgggaggcggaggctgcagtgagccaagattgtgccattgcactccagcctgggcaacagagcaagactccatctcaaaaaaaaacaaaacagaacaaacaaaaaatcaccttccatggttgccattgggattaaggggggtgaattgtaggaagcctcaaatattgcttaccaccccatgttctagtgatcaactatttagttctttacacagtcatgcacacagagaggcagtcccaaatcaaagcagccatttgggccaggggtcagcaaacgctggccccctggttgcctgttcttacgaataaagttttattggcaaacagccacgaccacgtctttgtatatgtcctgtggcagctctcaccctgtcttggcagggctgagtaattacagcagagaccacgtggccaaaagccaaaaatatttactatctggccagaggctgtggagatgagggagtgactgctataaatagtgaaaatactaaaaatcactgaactgtttagaaagaggaaaaggcaggcaccacaatagaatatgactcagccatgaaaacgcacgaggctctgacgcaggccaccttgaggacgtcatgctcagtaagagaagccagacaaaaaggccacacagcatgtgatctcatttctatgaaatgtccaggacagggccagccacagaggcaggaaggggatgtatgggtgctggggctgggggaggaggtgaggagtgacggctgatggagacggaatttctttatgtgctggaattaggccgggcacagtggctcatgcctgcaatcccagcactttgggaggctgaggtgggtggattgcttgagtccaggagtttgagaccagcttgggcaacatgatgaaaccccatctctactaaaaatacaaaaaattaaccaggcgtggtggcacacgccggcagtccgtgctactcaggccgaggcaggaggatcacctgaggtcaggaggtcaaggctgtagtgagccatgatcatgcccctgcactccagcctgggtgacaaagcgagattctatctcttaaaaaaaaaaaaaaaagatcactattcagccatttgcagaaagagcttgccaaccctagatttatagtgtagactgtggggccagatgggctgggttcaaattcccggtctgccatctgatgccgtgtggccccaggcaggtgacacatcccctgaaggccaccctgtcatcctctgtttaaaaaaaaaaaaaaaaagacggggccaggtgcagtggctcacgcctgcaatcccagctctttgggaggccaaagtgggcggatcacctgaggtcaggagttcaagaccagcctggccaacatggcgaaaccccatctctactaaaaatacaaaagttagccaggcatggcggcgtgcacttgtaatcccagctactcgggaggctgaggcagaattgcttgaacccaggaggtggaggttgcagtgagctgaggtcataccactgcactccagcctgggtgactgtctcaaaaaaaaaaaaaaaaaaaaaagaccaggctcagtgggttacacctgtaatccccgcactttgggaggcctaggagggaggatcgcttgagcccaggagttcgagacctgcctgggcaacatagcaagacccccacctctacaaaactaaaaaattaaattaaaacacaaggataatatcacagccccagtggggttgccgtgggagtcggggaatttgggtgtcaatgtggtcagtgctgctgggtttttttggtggttattgttactaaacgcactgagatgccggcaggaatgacacccacagacacacagtcacacggtcacagagcagaccggctggagcccccaagtaacccccgcttcccactgtctccgcagggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccggtgagttgggcggggcgcattcgggcctctcctggcggctccaggtgacctcccgggggccacgtgctcacacgaaggcacaacctctgcttaaaagggtcttgaggacttggctctgaagtcccctcctctgtcgtgctgggaggcagctggattgggtcagaattgagatgctttcggatgtcagggtttcgggcgcatcatgtcgcaccctgtggggtctgggtagcacccgtaggtcccagcaactgcgtgagtcgtactcatgttaacacaaggcagggagggactgggcatagcggctcatgcctgtgatcccagcgctttcggaggccaaggcgggaggattgcataagcccagagttcaagaccaacctgggcagcatagcgtgacccagtttctacaaaaaaaatacttaaaaatgagccacgcatggtggcgggcgcctgtagtcccagctactcaggaggctgaggtgggaggatcgcttgaacctgggaggtcgaggctgctgtgagctgtgattgtgccactgcaccccagcctgggtgacagaacgagaccctgtctcaaaaagaaaaaaaaggttggggggcggggggcaggaagacattgattacaaaaaaaccaccaaactcagttcgagcaagacagcgtttgccagactccacaggaagctttggatgttcagagcttttcggactttggaaccacgggccaggccgtggatgatggtggatgatggcgtgctcgcagtgaattaggaaaaacgcggagaacctgctgttaggaggcggtggcactgtttggaaggaaatcagtcgagttggcgtgcagggggtttacagaggagatgcagtgagcgtggccccagtagtgccgggctttgagtgacaccagcaagcgggtgtccccaggcccctccacctccggccgtcctcagacccaccaaacccgccatggtcacacccgcgccctggccccccagcctgccaccccgtccgggccgtgcacagagccgggggcggccggcgccagcagcccgaggtagagggggagcccaccccttaaccacgtgtctctctgttcccccagttaaatggaagtggtcagctcaaaatgcccagccactgcctttctgctcagatgctggcacctccgcccccggggctgccacggctggcgctcccccctgccaccaaacccgccaccacctccgagggaggagccacgtcgccgacctcgccttgtaagcacgcgggaagcggtgccctggtggggcggatgtccgcaggggggcctgtcccctccccagccccactgccaggtcagaggtcaggcccgaccctgcagggcctggcgagtttggtgggtctccggaaaacagcccagtggccacgtggttgggcccatgtagggctgaggcagccttaggggctggccggaccaagcctcgggccagggtgagagtccagggtctgtccccttcgccgagtcacctgggggaccccggtgcccgccgtgggccgtcagaaaccctccctggtatgtcaggcagctgacagtggacacggatctcacagtggcggcccgagggccagactcgacccccagactggtcttttgtttgtggagaaagagaatcggttgttatcattttaaaatcaggacgttttacataaacatttccagagttctggcttcttggggagaaaggagctacaccaggcccagttcctttgggtgacctgggctggaccacacctttagatgggactctcttcgcctgtccacctgacctggaagcccctgggttggcggctgctgcaccttctagatttttctgctctctggatgtggttctgggtggctgctggatggcccctcggtcctggcatccctgtcctgaggtccaccccattcgtccgcagtggctctacccccagactctccccacgacccccatgcaggcttgggtgggtcacccaccctcacagggcgccagacatctctgaacccagagacctctccccatggactccatctgcccctcacccccctttttgagcatctctgtccctcactctccaaatgagaccccccaccccacccaagcagttggtggccacggttccttctaggtgccctcagctcctcttctccctgccccggcgttcctgtccccgtccccactgcgtgccagaacccaggctgcctgcccataaaaaccggcttctgatcactggctggaggagatcagccccaaatccaccctgggctggaatcccacctctgcagctctctcactgtgtgacctcaggcaggtgtcttcccctctctgagcctcagttttctcagctgcaaagtgggtttgccttggtgcccaattcacagggcagtgggggacaagccggtgacatgggtcagggaggcagagaggacattccatgtggcgcctgatgctgcgtggtgtcaggcagctgtggtcattcttgccggctgtccctgcctgctcatctgtgaaatgggagcgttgactgcataggatccagtcagggctcagtgggatcatgcccagagcctggtattcagtagacacttaataaatgcaggatactgcgtgggatccactcagggctcgatgggattatgcccagagcctggcatacagtagacacttaatagatgcaggatactgtgtaggatccactcagggctcggtgggattatgcccagtgcctggcatacagtagacacttaatagatgcaggatactgcgtaggatccactcagggctcggtgggattatgcccagagcctggcatacagtagacacttaataggtgcaggatactgtgtaggatccactcagggctcagtgggattatgcccagagcctggtatacaatagacacttaatagatgcaggatactgcttaggatccactcagggctcgatgagattatgcccagagcctggtttacagtagacacttaatagatgcaggatgctgcttaggatccactcagggctcggtgggattatgcccagagcctggtatacagtagacacttaatagatgcaggatgctgcttagtatccactcagggctcaacgggattatgcccagtgcctggcatacagtacacacttaataaatgcaggataggcatggattccacccccctttccctgcaccggggctcttaactgcaaatctactcctacttctccccataagcctcgctgcctccagctccccccaaccccagccaggacaacttggggaccctgcctgttgcagcttcttctccccctacctgggtcccggcctgtctgaggcccccatccctgctgtagccccaggccgtgagttactcacacgccgacaaaatataatcgctgaggctgaaatataaatacgcacatctgtatgtatgcacacacccagccctccctctgccctctccgggaggaagattaataaataaaacgccctcaataattcatgcaccccgcgcggaggcagccctcagtggcaggaccgggcgggcgctgcccaccctgaataattcacgggcggttttgtgaattacagagccatcctgccttccctctcagcagacaccccgcccacctgggcgatctcagccgtgacccccgggcccctcgagtcaggatccccgcctcccaaggaccttgggcctttcaggggggcccggttcaactgggggtagggcggcaggctcggaggccccaggcactgggtgcagaggcccggctgtgtgacgcctggcggtggccaccctctctggggccagggccgccccggctcccacaacccctcgctaacgggctctcggtctctctcctccctgcagcctactctccgcccgacacgtcccctgcaaaccgttcctttgtgggattaggaccaagggatcctgcgggcatttatcaggcacaggtaggggccgagaggccggctggtggggtgggaggggcagggcagaggggccggcccggggggctcagggcgaagagggcctgctgggtcccacgccacacccctggcacaggggcgccagcctcccacaccccacctgggcctcgagcccccacctggcctctccctgaggccaaatttccctccaccttggtcctggggggatggggtgtggccccagactcagcctgtggggtccccaggagcgtctctggagaccatcgtggtacagctatgggaccagtgtcattaccacctgcttcccatggtatagatgggaaaactgaggcccagagagacaagggggtctgcccagggtcacacagtgcatcaccctccctcctccagcctccatcccccatccacgccgaggcctagagggaccgcggggtggccgggggaaactgaggcagcccatggcggggcgtggggcctcccaggacagcatccaagcccccaccccaggcttcagcccacatctaagccagtgtgaggagtcagggcggagaggcttcgtcagcaggacagacaggatggggcaggggccagcgttcatgttcacgttgatgttcatagtcacgtacatgttcagacggctgcagctgagtgagcatggccggggtcccaccacccctagaaggcaggcaggcaggcaggaggttgacagaggaggctcagagaggggaagtcaattgcctgaggctgcacagtagtctagggagtgggggcgtgggagggcagccttagccccaggcccaggtgtccctcaccccccacccccataaggggctctgtgtaggccaggagtgtgtgagcgcgtcttcgggttatgggtaagcagctggacctttgagcctctgctctctccccggtttgtgttggggagagggttggaggatgtaggagtggctgccacaggcccgggaggtccagactcagagagaaacgagctctgggctacccagcggccacggaactgcagagcgtggagatgtatggggtccccaggggccgtgttcaaatcttccagccactgagggaggtttcctgctgcagagcccacgggcaagggtcacggggcctccccgggaccctgcggggctgtcctggctgagcggatgggggcggggaggggacatggcattccccctccctccctgtgctgggtgcccaggatgcctgtaagcggcccctccctctcttcccaggctccgcaaaaccagccggaggaggaagcagggatggaggctgcttctcctgagttcagaggagatccatgtgctatgggtggagggaatcctgggtcaggggccagggctccagcccagtgctggctcacccactctgaacctctgtctcttcctctggccttgggcacccgcaccaagagcctttgaagggcactgggggacagaaagggcactgaaaggttcaggcttccccacaccccgtaaatattaagtaccctgccttgcacccatagagccccggagagggagtaacttggtcagggtcccccagcgagcagacgtccaggactcctcgctttgggatttgggccccctatggccaacctctcccccgcctggtgctgatggagcccggcattacctctgccacccccaccccacatcgctccctgcccctgcgggaggctgggaacgtcttaagtggttcagaaaccaaagctaataaaagctgcggtgggaggaggcccagcccgcttaacccttccccagcctctgccttggaccaaactctctgaccaggccctcccgccagggcccgggacccttctctcagactgtgctggctccagccccaccccacccaagcctgggagggaagggaaactgaggcaggcaagggtggcacctttctcagcatccctatcttgactggctggactcctctggggacccagaaagggtgggaccagggctggcagaatggggtgtgggggggcactggcaaggggctcagcataggcaatggtgtgggtcgggggagggggagctggctggaatgtgagagatctccggtggcaggggccagacagatgatgcgggctttgctctggggtagtggggagccatagaagggtttagagggagggagtggacacccaccaggcctgggagtcagaactttctggagcacagaaaggaggtgacacattgtcaagaggctctcaggggagcatgggttagggggaaggcgaggtccccaaactgggcatccagggagcacaggtctggggaggaccccattgctgctgccctgactggactaagagcacctgggttgaggccgggcgccgccacctccctgcagaccccggagagagggagggaagaagcagtgagatcccgctctcccctctcccagctcccgctcaaagggccctgagcttggaggcctctcatttccgattctggccagtcagcacttctgcctccgcctcctctattcctggcggattcgcttccctctgccccctcctcccccaaagcctgggtgggcgcgcctttccctctgcctctccggctcccgacaccccccagtccatggactctccccccatcaatatccctccccgtgatctatgctaattgatctcgccctggtcagttacccacccatcgccccatgtccgtccctatcaatccccccactgtgaggctgggtggctctgacgccctggcccctcccctctgtgatgtccttcacgcccctacatttctcctgcacgggaacccacgtaagcagctgggtaaaccgagggtggggggcaaggcgggcattgagccacatgccgggagccacacaggcggctgcagccaggccagcaggataccagagcccaaacctcccccttcacacctactgcctcagtctcccctcagctgagtgggaggatgtggagttgagggtgcccccaccccacccccgccccattgctggggccacagccaggcaggaaggggaggggagggaagggaggagggaggaagggctgaggggaggctggtccaccacggggagggtcacgcccagagtctgtcggttgccaacagaaaccagacatgaggtaatggccaagatgaacttgaacttggctggaggtggggcgctgggaaccactgtggcgccagttccatgggctggcccagtggctgcctggttggaggggctctgttgaatgatttgctgcagcggtggggggcggccccacctctaacctcagttggggagtggaggggtctccccagttccagaggcacagccctcccctcacagtccaccctggatgctccatctggggttggagtttgcgtttccagggcaggggtctggacagcagcttctctgcagagactgaggccggagctgtccccaaatgacgtgaccttgggtacagccccatgcagaactcccctcccttagcctcggtctcccgcctctgggaggttgagagtcatcctcagcccccctgtgcttagtgagcttctgtggagcaagagggggccatccgggggacctgtgacaggatgggccctggacgcccaggacagtgctcagaagatgccaaggggattcctgagaggcaggcgagggggttggccctgggcaggagcagaaatgagagccagagccagacaggcctgagttcaagttccacctctgccgcttccatgctggtgacctcgggcaagttccttgacttctctgggcctcactttcttcacacaaaacagcggtggagggagacctaccccctccttcacggggataccggggacatcattaaagaggagaatttttttttgtttttttttggtttttttggtttttgttttgagacggagtcttatgctgcccaggctggagtgcaatggcacgatcttggctgactacaacctccgccccctggattcagacgattctgctgcctcagcctcccgagtagctgggattacaggcacgtgccaccacgcctggctaatttttgtatttttagtagagacagggtttcaccatgttggccaggctggtctcgaacccctgacctcaggtgatccacccaccttggtctcccaaagtactgggattacaggcatgagccaccgagcccagcctcttgtttactttttaaaaacattctcaaggccatgtgcagtggctcatgcctataatcccagcactttgggaggccaaagcaaacgaataagctgaggtcaggagtttgagaccagcctggccaacatggagaaaccccgtttctaccaaaaatacaaaaattagctgggtgtgatggcgcatgcgtgtaatcctagctactcgggaggctgaggcaagaaaatcacttgaacccgggaggcagaggttgcagtgagccaagatcgtgccactgcactccagcctggtgacaagagcgtgacgctgtctcaaaaaatcaacaaaaaacctctttataaagtgaacaaggcagctgatgtggtggctcatgtctgtaatcctagcactttgggaggaaggagttcaaggccagcctggtctacatggcgaaaccccacctctacaaaaaaaaaaaaaaaactagtcagatgtggtggaacatacctgtggtcccagctactcgggaggctgaggtgggaggatcacttgagcccaggagatggaggctgcagtgagctatgatggcaccactgcactccagcctgggcaacggagcaagaccctgtctcaaaataaaataataaattggctggccacagtggctcacgcctgtaatcccagcactttgggaggccaaggtgggcggatcacttgaggccaggaattcaagaccagcccggccaacatggcgaaacccggtctctactaagaatacaaaaattagctgggtgtggtggggcgggcctgtaatcccagctacttgggaggctaaggcacaaggatcacttgaacccaggaagcggaggttgtagagagccaagatcacaccactgcattccagcctgggcaacagagcaagactctgtctcataaataaataataaatagagaagaaaataatttttaaaatataaaataaaggccaggcagagtggctcacgcctgtaatcccagcactttgggaggccgaggcgggcggatcacgaggtcaagagagtgagaccatcctggccaacatggtgaaaccctgtctctactaaaaatataaaaattagctgagtgtggtggcatgcgcctgtaatcccagctactcgggaggctgaggcaggagaatcacttgaacctgggaggcagaggttgcaatgagccgagatcatgccactgcactccagcctggcaacagagcgagactctgtctcaataaataaataaataatataatataataaagtaagattgagttccagactgggagtgctggctcacacctgtaattccagcactttgggaggccgaggaaggtggatcacttgaggtcaggcgtttgagaccagcctggccaacatggtgaaaccccatctctactaaaaatacaaaaattatccaggtgtggcggtggacgcctgtaatcccagctactcgggaggctgaggtaggagaattgcttgaacccaggaggcagaggttgtagtgagccaatatcacgccattgcactccagcctgggcaacaagagcgaaactccatctcaaaaaataaaataataaataaaatataaaatacagttccagataaatggatcttttgtgtgtggtgtgtaagtatatccccaatgttgcgtgggctagacttatactaaaagaattctgtgttaaccagaactccagtttcactgggcatcctgtactgtgtctggaagcctccctcagagacaaagtcacttgccatgggtcacccagcaggttgttagagcctgggatggggaaactgaggtcacagggttgcaggaggtggggggtgagcgtgggaagaggtaaaccatgtctgcagcagagtctgacccctcgacttctctccctttttctctctccctctttctgtcgccactgggccactcagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagagcgagtggtttaagtgcctgattaccaccacccgcccccccctttgtccagctgggacacggaatggccgcgggcctcctccccctcccctccagcctctccaccagcccctccagtcaaccctcatcgccgtgcccccccagagctagagagatggggcccctgcgtggcccgaggggcagagctgggcgtcacttcgcaagcgtcctgccctgccggggcgcgggggtgggctctggggaagccggtgcgccccccacgcctccgctgccagtgccttacattctggagcgacccccctccctggtgcctcccagcgaagggggaccgccgtttgcactttcatcgcctaccccgacgcggggcccagctgcgggacgtgcatcacggctgggcccccagaggagagaggaggccgacgccagcggtccccgctcggaacggggagggttttcggggggttcggcgtcgcaccttggggccccccgcagccgtgtagggggcctcccatctgctaagcgtttttccgttgagccgctccaaaaacactaagctggggacgccaggtgcccccccaccccggctccctggccctatccacacctccacccccaccccaggatcgccatctttaggggaggcctgggagggggtgttaggtgttttagggccaccgagctcaaacacaaggacccctccccggcccacccagcccagccccaactgacctccatgcctagggaaaaactccccccaccactgccccctcccccgacccaggccaaagccagggcaggtctccgggtctcacctgctcctagcctcacccccctgcccccgaaaaccagactctcctcccaaactagcctcaggagcttggcgaacccgctcgctcctaaagagaaagacccaggaccctcccccatcacccccaagagaggttcgccatcctctggcctcgagcccttggtccctccgtccgtctgtcctcggggcccgctcccccggtggcccttggggatcaaagcgtgggccgctctccgggagggcgggcgggggagggggtggtcgggttgtgccattggggtgtccggaagcttctcagccagggtgggggtcgtggagtgggggagggaggccagccgggctccagaggggtcagggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatctaaaaaaaaaaaaaaaaaaaaaaaaggaagaaaaaccacgctaaaaatcaagccactgaaaacaattgcccccaggtctacccagcccctggctgtccttggtcctgtctcccctcctgctgtattcaggggtgccccctggtgctcagcctctaccacccccaaccctgctcttgggtacccagaggggtcatttctgaatcccttgcccagaggacagacctccggggcccatcttggccctgggaaagggctctcctctctgattggtccctaggccacgggccggcccccagacaccattcaccgacccactgcaggctgtcctccaaccatggggtggccactccacccgcagccagactccccgctccccacttttcatgcaggctggcatacccctggctcagggtcaaatgctgttccacacccacctcagaggcaccccctctcccctgccccgtgcatccccacccttcttgccaaaggacctcttttcccctatccagagaccaccccaggtggcattctctcccaccttctcctttgtcccccatcccctgtctctgtcttccagctgtgaatatgaagggtatcctgtatgaaacaaaaacaaaacctgatatatgcaatatctgtctgtctgtctgtacccatgggcctggctcagccattggaggcccagccgagggtccggcagggcacagggacagccaggtggcaccgagtcacaggctgtggtccggtggctgagcatgctgttgtcttgtccttgattttattttcttttgttctttttttttttcttttctttttgtttttaactccagcttcctttgctttttacttgaccaaagctaagacaatagccagatggttagtggggcagccaggcagggaggacccagggctgggattctccaaccttaggccattcctgcagccctcaccacctccagcccctccaagcatctcgtgtagggacccacgcagatggtcccattcattcactattgcccccaaccccgggattttgggtggtctccacagccaccatcatacactcatcccgtgttttcttccaaaaagtcacctcagcagcctccccaggcgatacagagggagagcccagaccaccacagctggccacgacattgcccttaagtaatatgcattggccagagagcccgggctggctgtgcacagcattcatgtagctgatttctagctttttttttttttctgccccactcctgagcaaatctgtcttgccaaggaactaggagcaaccggaggcaaagggagtgggtggccccatcactattgggaccatcgcgtccctgcacagcccacacccgggggcccagagtcctgggctggacgccacccttctcaccccgagcttgcctccttggctcacttggcaccttggctgagtacagcaggcaaaagcccataccaggcagcatgttgtggatggtttagttctccccgcctccctgtttcttggaaaagctacagggtccctgtagggcaaaattcccaggcgccttgctgcagacagagtaagacaaaaacaccaggaagcaggattccgtgcccatctctgcagtttgggttcacaaaagggggtgccgtcatccctgggtggaggagggagtgttggttttttgtttttgtttttttaacatgtatgaaactgacatcttctcaaatcttgttccacccccctctggaagcccccatcacccacccctgctatggacaccacacctatgccaggcccccccccccaccccagtctcattctggggtctgcccatgctgtgggaaagaatagggaggcctcccaaatatatgcaaattgtccccattccgtgggggcacctgacaatgacccgggtggagatggggcatggaggagtaggaagacccagccctatttgactggggagaggaggatctggagtccttcatgcccaggtctggaacccaggttctgaccccagggccccaccctgggctggacaatcagatcccaaaggaatgccaaaggggactcggttgggagagccgcttaggggccagacctgggtccccctgcaggtccccaggcagcagacaattccaccttccctgccccaggaccttgagagacagcagcattccaggcacagacagacttggctgcaccccactgtcccttgcaagacaggttctggagccaggagcaactgtccagccctccagaagagacagcaagcagcccccctacccactctggcctccccaatggtactttgacctccagtgtagggctatactatacatatatatatatatatatatatatatatataattttggaatttgtttctcataatacagaatatatagtggctaccttgtatcttggtctggattctctctctgagaccccggattttactttctctttggagggcgctgggacatacatctctcaatccagcttcctccgcatcctcccatcttgccccatttctgccacgtcagacacttcctgagagtctcaccttcaaaatgacaccgctgcccatccattgctcaatggtacagagtgtggggtcagtccaccacccttgacctcccggcagggcaaggtgaggaggcggacccaaagcagtaccagcaggacttgttgccagtgataccaaaacagacttttcccaagcagtgcctcacatgtctgctggtgtggctttgggattctcctgccccacccccccgtccatggcagccccctccccaaggctttgctcacacctgagacaggaaggaggaaggggatccaataggaatatgggccccggaggggaagtcatgcacccccaagccaccaccccccagccttccacgcacatctcctggctggaagagagccctccaaaaaggggacacaggctgccccggcccctcaactgcatccacaccccatcctctcatcttgggtcccagccaggcccccccaaaaccaaagccccctcaagtcctggggtcccagcctgtgcccccagcttcctgcccacccagccctgagcattctcacacagagaaagaacaagcaagggctccagggggacaggatggggcagggcatacagtggggggtgggggggcagctgggaggagggagggacaaaacaaaacattttcctttgggttttttttttctttcttttttctcccctttactctttgggtggtgttgcttttcctttccttttccctttgagatttttttgttgttgtttcctttttgtattttactgatatcaccaggatagtttactctccttctagctttctgcttaccgcacactggataacacacacatacacacccacaaaaatgctcatgaacccaatccggagaaggttccagcaggtcccccaccctcccctcctcctcctacttctcctcttgacagcgaggacaggagggggacaaggggacacctgggcagacccgccggctctccccccaccccaccccgcccctcacatcatactccaatcataaccttgtatattatgcagtcattttggttttcgcggacgcgcctacctaagtaccatttacagaaagtgactctggctgtcattattttgtttatttgttccctatgcaaaaaaaaaatgaaaatgaaaaaagggggattccataaaagattcaataaaagacaaacaaaaaaaaaagaaaaaagaaaaaaatgtataaaaattaaacaagctatgcttcgactctt

SEQ ID NO: 2448 - DNA, 109656 bp, Homo sapiens
cgctcgctccctcccccgcgcgccctccctcgccgcctcctcccgccgcctgcggcccccccctcgccggggaccgagcgcgctcgctccggcgccggcctcgcctcctcgcagcagcgccatggtacgtcgccgcacccactttcgttttcgcccggggactttttggggtggtgcgtgggctccgggcgaaagttgcaagatctggggggacagggggcgggggccgcccggaggaggggctcgaggcggggacccccactcgccagtcgccacgggacccctacccacgatccccccccgcaccccggctgggggcggagctggcgcgcggggcgccgcgggagaccccaagtggggggcccctcgcgggcgccgcgagttggcgaggagggcggggctccccggagaaggcccccgcaaccccaggccgggcccccgccccctccccgggccagaccccaggcgggagggcgcggccctgggcgcacgacccccgagcgcgcagtccgtgggggagcccgggccagggagggggcgcacggcgggacggcgcgtggggcgggggtcgcggcggcccccgcggggtgccccggcccgggcgagcgcggcgcgccagctagcggaaaatggccgctgcggagaggggcggagagcgcgccgcggccgccgccgggcgccttgaacttggagccgggcgggcggccgcgctcggcgccgcgcaggagcagccgccccgcctgccctcgcaccgcccccgccccgcccctcggcagacccccggccccgctgccgcgcgcgcggggtccccagctgggagggacccccgggtctcggcccggcgcgccccaggccctggagcggcggtggctgcacttggggttccggtgtccggtcgactggcgtcggtgtcgtgcgcacctcgaggggtgcgtgggagcccctgcgctccgtaacgggccggcattggcatctgggggagcgtctggggtgtgcgcggcggggtggtagtgtacctgccttggggccgcgggtcccggcgcgtcggctccgccgctttctgtgtccgcgtgtgtctgcacatccacgtgctggcgcgtgttgtgttgtgagcgccgcccgcattgtgcggctgcgggacacttgtgtctttggataactgggcgactgtgcgcgcgtccctgcgggacggtgttgtgaaactatggctgggctgcgtgtccgcggagccgcgtgtccctgggtgaccgtggggtgtccccgtgtgggtgtgtggcggttggggggggtcgccagggagtggagaactgtcgagtggccgcgttccaggggacagttgggtgccgcttgctgtgtgcgagtgactggcgctgagcctccccctagggaagggtctgccttccactcccggcctcgcctcccccagttccttttttcctgtaactggggactgcctgggcggcggaggaagagcgctccctccaccttttcaaaactctgtccctttatctttcccctacgtcccctccacttcccccagccttcggggtcccccatccgcttggcccgagggggtcctggctggaggttcgggcgcgaggtggcgccgggacgcgatcactcggcacgcagacgtcgctcgccaggggttgcgcttgcgcggggacctgccccgagaggggcggggcggcaggggttccccctccctgagaggccgtggaagtcccgaggggtgggtggttacagcagcacaggggttaggacgggcccgggaggtggctaaggagacccctattatcctatgctggggagagcgtaggggcaccgggactggtcccgcagtcccgcctccagcacttgcccccaatggaccagaggccgtgggcacagagagctgttttgtcacctccagggaaatccccgccgctctccacccccaccccacccccagtgcgtttgatataattttctaaatataaaaagcccaaggccaggctggtctctctcgctttcttcttgacatcccatcatggggggctgtttgggatgtcaagaaggagagaaaaccctcccacaatgacacagaggcctcccccaacaacactcaaggtcattctcgggttgtcaccatccctcacacccactcccagcctcagactcacagctatctccctccgcactcccggagggacggttggatgccctggccttcagcacacggcatggccctctgtccccattttgggttctgtgcacagtgggacacacgtgcatgcagtcatagttacacacacacacacacgacactccctcacggtgcctgtgtctgcatgactctgcacacacaaccacacagagactcacatagacacacacaggcctgtctagagacagacgtcacacacacaggcgtgcacagacacacatgggcagacacactcacggacacaaacaccgcacttgcggggggatagacaaccacatctcaccctcctgcccttccctgtccccaccgcgtttctgcagggccgagagcccagctccaggcagagctggtgcaggaggagcagggaggtggcgtgctgtgtgtcattgtgatggtgcgtatgtgactctgtgtgtgcctgtatgggaataccggggggttccacttgtgggtgtgtgtgtgcttgtaagagtgtgtgcttttgtgtggagtgtgtctgtgattgtggacaagtgcccatgtgtttgtggttgtgtctgcacttgtgtgggggcagctatatccatgcgttgtgcttgtcaagaagcgtcctgtggggagttgggagggtgtgtttgtggctgtgtgtgtgccatgtgggtctgtgtgtgtgtgtgtgtgtctctgctcgcccctctttgaggaggtatctgaggtcaggtgtggggggaaggctgtgatgatatatgggtctgtttttatgtgagtctgtgcgtgtatttgtgtctttgtgtatgtagctgtgtgtcgtgtggagtctgtgtctgcagctgcttgagtctgcacgatgtgtgtctgtgtgtctctgtaggtcgtagtgtgtggtgtgtgtgtctatctgtaccagcctcaacggcctatctgacctttaactcacttgactttaacatcccttcttacagcctcagtttctcatctgtaaaatgggaccacatgggacccttgcaaggttcctggggagctgacattgtgagccccttgctgagcaggtgcggggctaggggaggctgactgcacactgcactgctgtgtaatcatttgcctgcaagattatgtcctttattctctgggtgtggtggctgtggggttaccatggggggctgggggttcctgtctaccctgcctgagctgctctgtgaattgcattcaactttttaagttttcctttaattactgaagccattagtgatcatatgaagaggatacaactgtatccagaggaaaaaaaatccaatctttctgatcacccccattcctgggtggaaccccgctccagaatgttaccatctatagttggagcatttgcaggactgagaaatacacacttatagaggatacatgtgcatatgtgtatatttccataaaggatgtacttgtggaaatactcgtgtatttccataaaggagacatatgtatatgtatgtgtatgtgtgtgtatatatatatatatatatatatatatattttttttttttttttttttgagatggagtttcgctctgttgcccaggctggagtgcaatggcatgatcctggctcactgcaacctccacctcccgagttcaagcgaacctccagcctcagcctcccgagtagctgacattacaggcaccctcgcccatgcccggctaatttttgtaattttagtagagacggggtttcgccatgttggccaggctgattttaaactcctgacctcaagtgatctgcctgcctcggcctcccaaagtgttgggattacaggcgtgagccactacaaccggccaaaggagatatgtgtgtgtgtgggtgtgtgtgcatgtgtgtgtatgtaaaggatactatgtatatttgtataaatacatgtgtactctttaaaaccctaaatgagatcttgaatttccttgctgggtctacagcagtggggtctcagccagggttgattctgttcccatgggacacttagccatgtctaaggacatttgtggttgtcacgactggggggtgcccctggcatggagtgggtggaggccatggactctgctcagcaccctgcagggcccaggacggccccaacccagagagcgatccagccccagtgtccacagtgccaagggggagagctctccagctttctgtccccccacttgtctcttggggacataaccagttgggagccactggttttactcagctgcatagtgtcccagcctgtgttgggattactaaaccggtcccccacagatggacagcatggctgcctccaaattgtgggcattagttttataggtggcagtcaactcttttgtgctcctgtatctgggacagttacagagatgccgaagagtgaaataactgtagagagagtgctttgaaaaaaaaaaaaaatgagccagattgtgctcgaaagtgccaggagctaaatcatgcacccatcttccgggccctccacatgcaggtcccaatctaccaattgcctttttaaagaaactatgacgtacagttccctgttgtaaccacgggcaggtatttgctgacttgcctacaacctggagggttatgagctggcgtcgccccatttcacagagggagagccgaggtgcagagagacgaagctgctgactggaggagacatagacccaagcagcgagcccacgcggcaatttagggaaccaactgtgtgtgctgcgggggtcccttgccacccaaactgggatataggctgctgttcgtacacttgcagaagtttctccctgcagctaccgccaccaataatattcacacagccttcccacatgctatgtaaagactccaaccttccccacctcccaagatgcatcctgttactatagccattttacagatgaggaaaccgaggttccaagaggggcagtctctgctctctaaacttcaccttccaaaggattctaagctgctgaatgaaggctgcaggcagggtggtctgtacaggggagggagggtggaaggcacggggtctggaagtctaggaggagtgtctgaagtcaactgcaacttttaaatatctgtgaattttagatttcaccctgtatgtgtccctagcgtgttttaataaaataaattgcttcacgttatattggtatgtggatttccagatacacttctcaccatttaattcaaatgctccccacagctgcacagtgggtttaaaatacacagacacacacatttatggaccgttcgtgatgtactaagcactgtttgaataatgtcaccgtcatgcagaggggagcctgtggggggcctagggaacctacgctgcaggaattctgctccctcctagtttacctgtcagaccctgggcaagtggcttccgttctctgggcctcagtttcctctcctgtaatgcctgaggataatgggtgctggtatcttctgcgcccctgggcctggggcacctgccccagcttggtgagagggtatcatttgtccttgggaagctcagagagatgaggtgaaatggccaagctttctaagaatgtgtctttagtgaacatttgacccaaggtcaaggctctgctaaggtcattgtccttatccccagcaatcccacaggatgggcatctttaagccactttataggggagaacccttgggatgggaatgagagacacagcagcctctgagctagcctgggaggatccagggagtgaaccgggggagggttggggccctgtcatcagatgccctgggggctcagacggaggcaggccaggtctctgccctgttacgtctagaaggagaacagaatgtgggctccaggtccagatggcctggctccaagccacacttgccatacctcagtcttgagatctgtgaaaagggcacacccctgaggcaggtggaaattattggatacccagggggaggctgcaagggtttatctggccagctggagatcccgcctggacaccgtcctcctggggtgctggagagacacacaggcgaggccacccctcccctgccccttgggtgctgggtgaagagagcaaattctggagcctcccgtgttagcctgggcccttctggccaaggaagggacagctgcacacaagcccctctagctggggacccgcagcccctgcctggctctggggggagaagggagccagggtgctgtgggaccagctcaccgtgcacccagggtcgtacatctttaaggggaaagaggcgcgctggccggcctctgcgcacgtcacttcttcattccttccctcccccctggctctttcctccaacttcccggccagctcgggggtgatgggggggtggggagggggggccttaaaaatccacccctggcccctcaatgtccagaaacaaccctgtcccccctctccgcttgatccgaattggggtcgccctgcagtcctggggtcctggtctagtgccctggggcattgcgtaaatacgggaggagcgggggggtcctgagacgtcgggggaggctctcctttctcgctcgcgcccttttttccctcgtttctttgaaagttgggtgttgagaagtgggaggttcggggtgggagggggagggtgtcagagggtagagagagagacagagagacagagacgggggagagaggaagagagagacggagggagagagggacagagagcgaggcgggcggcgcgagagagggagagcaggagggaggaggagggagaccgagggaggaggcggcgaggagagcgcgccggccgcggggcgggggggggggttggggggggcgggggggtggtttggaaaaatgactcagtaagttcagcgcgcccgctccggccggccctgcgcctcccgccgcgcccgggatgtattcgtccccgctctgcctcacccaggtacggtcctcgcccggccccccgccggcgcccccgcgccccccgcatcccagccccggagttttgaagcaggaggaggcgggacgaaaaaggcgcgcgtccctcccgccatccctgcccgggatgccccccgcgccgagggctggggtccggtggggggatgggtcaggctggggtaccccccccacacccttacctaccgcggaccccctacgcgggactcccgcccagcacccccaaccccgactctcgggacctctcccggatgtggggcttggtctgcagatttgcgtcccccccccacacaccgacgcactccgcacccccgccccgacactcggaaaggtcggggtgggggctggcccccctccagcaagggctctgcgggaagccccccgcctgcctctgagaggaatctagggggtcgtgattggaccctgggtctccccagctggagagaaagggacctctcatgtgttttccccgtgtccccccaccaaggttgtgcgggccgccctggccctcggtcgcctttccctcgttattggcccacgtgtgcatggagggggagggggcaggagaagttggaggcccaggagggggaagggtgctccggcggcccggctgggtcccccctcctttgcaagccccccagcaccgtcccggtattttcgctgcatcgattctggattctggattctggattctggagccgccgccgggaggagcgggaggcccggcgctccgggtctggcccgggcactgcggcgctgcggacgccctcgccagcccggcacctgccccgtcccctccccctccccctccccctcccgtagcctctcacccctggccgcactcccagactgccccggggccgagccttgtgcaatggccgagggggtgtgtggggagggggcggctccccccggggactccttccagcccaggctcccggggaccccgaggtctgcaagttccgttttctagaccgctgctttcctccttacgcagtgtgtctttaggctggagaggttctggcctcagtttcccctgaagtgaggtgcggctaaggccggttctggagaggggacagtatggcgggcaaactgtaaagtcccggcacgtggggggtgcgattccagcgagggccaggcccgtcttaagaagcactgtgtggggagtatatgagtccccggcttccgctccagggcatggtgcagtgagggaccccccacgccaggcatgctccttggtagggtctttctcaccggccccctgcagccgacagggaatgtgggagctggtgctgagggggtctgaggtctgtcctacctgtgatcccctgagtgaccttgggtaagtccctgtcccagcctcagtttccctttctgagcagctttggggggggggttcccgaagaaggcatctctttgaagttctccaagaacaactagggttcgagtgggcacgctgtgtgacctcgggcagcctttgaagtctctgggcttgtggggtgactgaggtgtccccgctctgtcctcaccagctggaaggagccatttgggagggctgagcggaggggaggctgttccaggctggggaggttggaaggctgcctgtgcaccctggaattcccccatcagggctggttgggagacatcctggttgctggggtgggttgggggttagtaagaaccccagtccaggctttgcctcagagaattgctaactcggcctcagtttctccaggaacagggcaaggaccagccaggagggctgtctgtggaaaccaaaaaacggagaggctaaaaactaaaaactatccaggggtgctgcgtgcaagagacagagatgagaagacagagacaggcagagagacagaggcagagagctcccaggccagagtggggacagcgagtcccaagtgcagggggctccctcctcccctgcgattctcctctctgccccgccctccaccccagccctgtagtggagctggggaccccctttccagtttgtcttcagcctgaatgtaatccccactgttcccccaaggcccagcctggtctggggtagccagtggggtgggctgggggactcagaaggaccctgagtgccccatgcaggagcctcccacccaagtcctggctgcctgactcagtttcccgaatcacgtcccctccgtttctctcatcttggtctctttttgtctgtctttctctctttctctctgtcttgctctgactctgtgtgtgtgtgtgtgtgtgtgtgtgtgtgtgtgtctgtttctccctgtctctccatctctgtctctccccgcctctgtttcactcccagtcactgttggtctctttgtgtctctctttctcatcctctgtctctctgatgtctcagtctctcccactgtctctgtctcttcatgtctatctcaccatccctttctcctctttgtctctgcatgtctctttgatgtgtctctgtctctctgtctctccctccctttgccttctttgtgtgtctgtccgatgtgtctctgtctgtttctctgtctctgtctctctgcccccttcctctctgtctctgtttctctccaatatgtctgtctgtctcttcatctctgtctcaccttccctttctcctctgtctctgcgtgtctccccttgccccctctctccctgtctctctctatctctgcatgtgtctccttactcctctctctctgtctctctctgtctctgggcctccctctcccccttttcccagctaattttacaacctgagcccaaccgaaaatagctcccttttagctgatccgacccggatccttctcgggagccgaggctggcggggggtggggggcatctcggtgccagcccgctctgtgccacccgggcccggcccgccgagtggggagtgggtgctggcggccctggggcattctgggagccccgggccgggctcagcggtgactcaagcgctttttcacttttactcttaagaggaactgtgtggagcccatggctcccataaatcctgccggcgggaaggccggcctccccgcgcctgctctgggcctccctccctgcctccctcccgctggcgccaccgccacgttagttattccgggtttggggccaagtccctcttggccgcagcgtggcggattccccgagccacctccatcccgccaccgggtccctgtctcattcgttcgttgtttccttcattcgttcgtcccatgccctctcggagcacaatgtgctttgctgccatttctccagcagggtaaccgaggctgggagaggctgtcctcccaccccagacccccgacctttgttggattttctagatcttccttaagcatctcctgggccctggggataggtgggggtgggggaggcagcagggcccaggcccagtgtaggttcttagagggagcttggggggtgcctaccaggagcagggggcctgcagcccctcagtgccgggagaggggctaagagtcagagagggccagggcctgcccgaggtggcacagtggggctggcagagctggggttcaggccattttccatctggcggcttgggcaggtgggcgctctctccccgtgtgccccccacccggggcctggtggcctctgattcactctctacaaggctccaccactctcccgctgtatctccctctgggtctctctgtgcatctctctctgtttctccccctcccctctctgcggcggaggtgcctctgcgcgccagggccaagcgccctgtaaatcaccaaagctgggattctggcagagtcagcgttctcctctctctctctctctctctctgtctccctccctttctccccccatctcgctctctcctcctctctccctctctccttctctgtctccctttccgtctttccctcttcctttctctctctctccccgtctcccttctctccctctctccttctctcttctctctctctttctccctccctacctccctctctgttcctcttctttctctctgtctgtctctttctttctccctcccttcctctctctctgttcctcctcttctttctctctctctgtctctctgagctggcctccctccctgtctcacaccaaatggatgggaaatgctgcctgggcctcctgccccggacacggcccgccccccactctcctgcctgtgtccacgccgacctcacctgggtgcccatctgccctgagcacacagcgtgcgggcacccaagtcctgaccagttcacatccatgagcacacgctgggcgcacacgcgtgcacactccctgacacccatacggacgaggacacagctctgcctgcctcggatctgccttgatgggggtcaccaacacacagacctagagtgcccctcacatctgcctgaaaatcttgctcaggaggtgccaaacccaatatagtacctggtatagagaaggtgccaaataactgctatagagtggtgccaaataagtgttgctgtgcttgtgattgttgctaaactaattctcctctttcctgactctggtgggtgacctgcccccacccccggaccgtttcttgccctgaaatgaagtcagcagaaacccccacttcctcagggctgctgcagattcagggaggcagcacaatttttttttttttttttttttgaggtagagtctcgctctgtcgcccaggctggagtgcagcggtgcgatcttggctcactgcagcctccggggaggcaggacatttctgaggtccacagtgcagggcttggtactcagtaggtgcccaataaatacctgttgcacgaatgaatgaatgaatgaatgaatgaatgaatgtttttggttgagaggcgggactttggtcttcccgagcctccatttctccgccaacataaaataaaaaacataatggcactttcctcagagacatcgatgtaccttagtccgacacctggtatacagtaggtgccaaataagtgctgctgtgcttatggttgttgctaaactagtaattgcattgaacaccccagaggcattttccagtttccctcccttccctctgtgtgtatttgcgcagcgtaagcccagctttgggctgggtgacaaggacagtggtgacctggaaaggcccaggctcagacccctctctactgtggcatttctgttagtttttcttttctttcttttttctttctctctccttccttccttccttccttccttccttccttccttccttccttccttccttccttccctccctccctccctccttccttctttccttctctttctctctctctccctctctctccctctctctctctctctctctctctctctctctctctctctctctcggagtcttgcactgtcgcccaggctggagtgcagtggcgtgatctcagctcactgcaacctccgcctcctgggttcacgcgattctcctacctcagcctcccaagtagctggaattacaggcacgtgccaccacgcctggctaacttttgtatttttagtagagacggggtttcaccatgttggccaggctggtctcaaactcctgacctcaggtgatccacctgcctcggcctcccaaagtgctgggattacaggcatgagccaccgtgcccggcctctgttagtcttttctccctgcccagccctgtccagggtctccctgagtttgaccagccctgtgtgggtaccagccttccttacacatgggggtgcatggataaggggggtcccagaggcagaagatgggagcattgcttcagtggtctggatgctggagatgctaacagatcaaagctgtgcccttgtgggaccgacagtctaggccgggtcggggacgggcaggaaacgaggtgaccaggactccttgaggatgtggtgtgcgaccgacctcggggatcaaacaaggggaagggaaccacgtgggactcggagagtgtgcacggtgcagaccaggtgtcactggacgctctggcccgagactgtttgctcaaggggcccaggagtggggtgggggggtgccaggaggcccagggaccagtcccagctcagttcctccctgactgtgtgactttggtggaagatttcatgcctcagtctcctcctcgaggtagtgggtgcaatgatagtccccactttcatagtagactttttttttttttgaaacagagtctcgctctgtcgcccagactagagtgcagtagcacaatctgggctcactgcaacctccgcctcccgggttcaagcgattttcccgcctcagcttcccaagtagatgggattgcaggtgtgtgtcaccgcacctggctaattttggtgtttttagtagagatggggtttcaccatgttggccaggctggtcttgaactcctgacctcaggtgatccgcccgcctcggcctcccaaagtgctgggattacaggtgtgagccaccgcgcccggcccctatttcgtagtagacgtgatagctcagcaaacgctcagcctgtaagaggcacagcctcgctccctgcctctctcctccacctcctggcccctctggctcagccctcattgtcctcccagaacatcaaggcacagagggaagtaggggacccagggttcattttgctgactcactgccttggcagagagtttgaaccctgtggactcagtttacccaaattcctcactgtggcccacaaggccctgcccagcctgtccttgtcccctcctcaaccctcccctcctctctctttcccccttgctcattctgctccagccacatgggcctcctcgctgttcctctaacacgccaggtgcggtcctgccccagggcctttgcatgacccatttctccatcagaaagctcctggcctggagtgccatctctcaagactttgttcaggtgtctcctcctgcaagagaccttcctggaccccccccccaagctaaaaaacaccccccaccccagagattctctggtccctcaaactcttaaatttcttcagagcactttgcccaacttgacgttttattacatattttgctgattttaaccatccgtccctgccccagatctggatccaggtgagggccgagcccaggtccctgccaagtcctcggcaccctacctgggaccggcatgcagcaggcactcactaaatgtttgctgagcaacagaatgaatcttccctctctgggagccgttcacatgtccacaggctgtgattttctgagccaggggaaggagcggcccaaggttagagcctgacgctggtgccggatgggcctggggttgtccgtgggaccatggacaagtcatccgacccggagaagaaggcattagaactaaggctttgaaggatgcgtaggaatttgggataagtgctaagtaggtaatgagctagattctcatgaaggattgttgagtcacttttacctggaaacttttggtttggaaattggagtttcttgtcctggtttgctggcctggactttcagggtgggaggagcacagggaggtgagtgagggcatcacccagtgcatggcgtggtcgttcagcaaggtcttgggtccagatgtctctcccagctgctgctgctctctttggccaggaagtcccagtgggctaagctggggtttccaggaaagacctagccttgttccccttctccccatcaccttgcaaggaacaaggtcaccaggcaagctcccctgtctccagcaggctgcaatattcctttctgcccattgtacagaatgagagactgaggcttatctgaggtgatctgttccccagccattcagatggtgaaaatagaccttactgtcacccagccaccttctccgacagtgggtgcctcaactctgggcctcaggattggagagggagaggtgatagaactggatggtcctggctagatctgggaaaccctgggttgaggaggaaaggctgcttgaaggaggggacactagagatagggcgttgagggatgtgtaggagtttgggaggattttcagcatctagcttgtcttggttatctcttttgccggttgggcctctgagggcagtaggaggtccctggggaagaggccctggttattgcaggtcatgtgggagaaacagagtgacaaccggccaaccaggccctgcctctcacgtggtctgatcccctggggaggacaagggaggatggggcagcaggtccatgacccagttacaagctgtttgtcttcctgcctctgtaactagccggggtcaccactgacgtgggcccccacccctgcccgcctccctggcacctgtccccggaaagggcacagagaaggggaggaacatagagaagggagggacagttagggaggaggaagggaactcagatctacgaggggccagatgagaaaaggaattaagaggagaggggaagtggggagggggaattcagagagagaggggggttggggagagaaggagttggggggacagtgatccctgcccccatcatggatgcctcccctgtcccttccagcagcctcttatcacagccccagtaagcgccagagcttgggtggcagccacggccccagctggacaacattgtccgggcctcctgcccgcctggcatctcctccacaggcaggtcctgcgcctctatgggtcctctctgccgcgtcccactgtgccccccaccacccccactgcccggcttccctggccagaccatctgggctctggtcccagctctgctgaccggctgtgtgaccctggacaaaccactccccatctctgggtctcatccagtcaggggcagggacgagattggacagggcctgggccgggccccctccacctcccctttgccttagcaggttggctggggaagcgggggcagcggaaaagggccctgaggtccggtccccgccgcagctgttacggtgactcacgctttgggggacattggggtgggggagcttcgctggtacaagctgactctggtctcactgggtggggaggctattttcagagcctcagtaataggtgaaatctgatgtcctgcccctccccccgaagcaccccacggccggaggtggcccaaggggacgtggagcacagagcagggagggtgatctggcagcagctgctctgcccatcccggcctggaaatgggaccgagtccagccacatccgctggcacacacagtgggagtccagggtcaacgtctccctaccttcctgagaccccaatcttacagagaacaggctgttctgagaaagggacccgtggccttccagggggtcagggccctgattcttatcctcacaccggccctgagaccctgtgggacctcagccaggtctccgcccctctctgagccttagtttccatgccacagaacacggagcggggcctcaggctgttccctgcttcctggaagattgtctgcaatcaaaatgatcatcgcagcaatcgcgtccatagtaatgaaaataccccagcatcttagaggggccgaggcgggaggatcgcttgagcccaggaattcgagaccagcctgggcaacatagcaagacccccatctctactaaaagtacaaaaattagctgggcatggtggcgcacctggaatcccagctactcgggaggctgagacatgagaatcgcctgaacccaggaggcggaggttgcagtgagctgagatcatgccaccgccctccagcctgggcaacagtgtgagacactgtctcaaaaaaaaaaaaaaaaaaaaaaaaaaaaaaaggaaagaaaatagaaaatatcccagtgccttaggaggccgaggtgggaggatcacttgagcccaggagtttgagaccggccaaggcaacacagtgagtgagactccatctctgcaaaaataaaaattagccagacatggtggtttgcacctgtagtcccagctactcaggaagctgacgtgggagaatcgcttgagtctgggagttcagggcccaagtgacctaagatcgtgccactgcactccagtgagacgcctgtcttttttatttatttatttatttattttgagacggagtctcgctcttgttgcccaggctggagtgcaatggcgcgaccttggctcactgcaacctctgcctcccgggttcaagtgattctcctgccttagcctcccgagtagctgggattacaggcgcctgtcaccatacctggctaattttttgtgtttttagtagagatggggtttcgccatgttggccaggctgatctcaaactcctgacctcagatgatccacccacctcggcctcccaaagtgctgggattacaggcgtgagccaccacaccaggctgagacccccatctcttaaaaaaaaaagtaataaaaatcacagtagccccagcactttgggaggccgaggcaggcggatcacgaggtcaggacattgagaccatcctggctaacacagtgaacccccgtctctactaaaaaaaaaaatacaaaaaattagttgggcatggtggcgggtgcctgtagtcccagctattcaggaggctgaggcaggagaatggcgtgaacccgggaggtagagtttgcagtgagctgagatcgcatcactgcactctagcctgggtgacagagcgagactctgtctcaaaaaaaaaaaaaaaaaaaaaaaatccaatagcaatataagttgtaatgataacaatcatcgcatcattaataacaatgtagtcctttgagagctggggggaggaaaacagctttctgtgctaggaagggatcacccctgtccgaaatgcccagcccagcctggtcaaggcagggagatggaaaggcagttttgcttctctttctcttcttgttccttgtatttattccaccttgaggctgagaaactaggtcccagatgtttttaatttgttttattttattttttatttttttagagacagggtcttactctatcccccaggctggagtgcagtggcacaatcacagctcactgcagcctcgacctctgaggctcaagtgatcctcccacctcagcctcctaagtagctaggactacaggtgtgcgccacagcaactatgcccaactaattatttttgtaatttttagtagagacggggtttcgacatgttggtcaggctgctctcaaacacttgggctcaagtgatctctccacctcggcctcccaagtagctgggactacagacgcgcaccacaaaaattatgcccagctaatttttgtaattttcgtaaagatagggttttgcctgccggccacagtggctcacacctgtaatcccagcactttgggaggcagaggcaggtggaccacctgaggtcaggagttcaagaccagcctggccaacatggtgaaaccccatctctactaaaaatacaaaaattagctgggcatgatagtgtgtggctgtaatagtgtgtgcctgtaatcccagctactcgggaggctgaggcaggagaatctcttgaacctgggaggcggaggttgcagtgagccgagattgtgccactgcactccagcctgggtgacaagagtgaaactctgtctcaaaaaaaaaaaaaaaaaaaaggagatggggtttcgccatgttgcccaggctgggattgaactgggctcaagtgatccacccacctcagcctcccaaagttctgggattacaggcgttagccatagtccccagctgagatcccaaatgctatgcagactcagtttcccttgctggaaaatgggaagaatgggaggggcctccccacacccagacagggagctgggggcctcccactgccccacatttctcttcaaggggctgctgttattttcgtggggaagtcagatgagtgcaggttccagtccacctctgtcccccatggccgggttccccctcaaggcctcagtttcctcatctgtagcatgggtgttgtgactgccctcagacaccaatttgtcatgatttgggagtaggttgaagtcccagctctggcccagtctcagcgccttcccagccctcggattttccatctccagggtgggtctgcagggaacggggtggcccctctccccagttctgaacctttgtggctgagcgtctgcttctctggtctgtttctgtatcagcacagtgggttcatggaaaggggaaaggagggagaggactccacccgggatttctcctccctctgattaatcctggtgcacttgaatctcttatcttttgatgcagaaatccccccacccttccagcagccctcaacctccaggcgggcctagtgtctgcctgtggatctcagccaggcctgtctgtacatatgctctgtaggaacaagctttcgtagtcattttttgtttttttgttttttgttttcccaagatggagtctcgccctgtcacccaggctggagtacagtggagtgaccttggctcactgcaacctccacctcccaggttcaagcaattctcctgcctcagcctcccaagtagctgggattacagtcatgcgccaccacgcctggctaatttttgtatttttagtagagacagagtttcaccatgttagccaggctggtcttgaactcctgacttcttgatctgcccgcctcggtctcccaaagtgctaggattacaggcatgaaccaccgcgcccagccgggttttttttttttgagacggagtctcactctgtcgcccaggctggaatgtagtggcgagctctcggctcactgcaacctctgcctcctgggttctcctgcctcagcctcctgagtagccgggactacaggcgtgtgccaccatgcccagctaatttttgtatttttagtaaagatggggtttcactatgttggccaggctggtgtcaagctcttgacctcaagcgatccacctgcctcagcctcccaaagtgctgggattacaggcgtgagccactgcgcccagcctcatttttcatttttttttatttctttctttttttttttttttttttttttgagtcaggagtcaggggtctcactacgttgtcacccgggctggagatcaatggcgcaaccttggctcactgcagccttgacctcctgggctcaattgatcttcccacctcagcctcccaagtagttgggactgcaggtatgcatcacctagctaagttttgattttgtagaaacggggcctcgctatgtcatccaggctggtcttgaactcctgggctcaagcagtccacccactgtggcctcccaaagtgctgggattacaggtgtgagccaccatgcttggccgccgaccctagtttttttttgttttgttttgttttttgagatggagtcttgctctgtcgcccaggctggagtgcagtggcgcaatctcggctcactgcaagctccgcctcccgggttcatgccaatctcctgcctcagcctcctgagtagctgggactacaggcgcccgacaccacgcccggctaatttttttgtttttttttcagtagagacggggtttcactgtgttagccaggatggtctcaatctcctgacctcgtgatctgcccgccttggcctcccaaagtgctgggattacaagcgtgagccaccgtgcccagccttgttctttttttttttttttttttttttttgagacagtgtttcactcttggcacccaggctcccaggctggagtgcagtggcacaatctgagctcactgcaacctctgcctcccaggttcaagcgattctcctgtctcagcctcctgagtagctgggattacaggtgtgctccaatatgcctggctacatttttttgtatttttagtagggacggggttttgccatgttggccgggctggtctcaagctcctaacctcaggtgatccacctgcttcggtctcccaaagtgctgggattacaggtgtgagccactgcgcccaggctttttttttttttttttttttttgtgacagtcttgctctgtcgcccaggctggagtgcagtggcaccatcacagctcactgcagcattaaactcctgggctcaaatgatcctcccaccccagcctcccaactagctgggactacagttgcaaaccaccatacctggctaatttttgtttttttgattttgtttgttcatttgttttgtagcgatggggttttaccatatggctcagactggtctcaaacttctgggctcaagcagtcctccctcctcggcctcccgaagcgctgggattacaagtgtgagccattacacccagcccaaccctagctgcaataggcagagaataggtccctgacatctttgttctcccaacctcagttttacccgtctgtacaatgggttgtccatgagcctccacctggcccccttagcttgctccatctgcatgctggggttcaacataggtcctccacggctgggcatggtggctcacacctgtcatcccagcacttggggaggccgagagccgaggcgggcggatcagaggtcaggagatcgagaccatcctggccaacatggtgaaaccccatctttcctaaaaatacaaaaattagctgggcgtggtggtgggcatctgtaatcctagctactcgggaggctgaggcaggagaatcgcttgaacccgggaggtggaggttgcagtgggccgagattgcgccactgcactccagccttagcgttaagagcaagactccgtctcaaaaaaaaaaaaaaaaaaaatgatcctccacaaacttccgccttgatttgtgcctctcacatagtccaagtctgtttgctcatctgggcgatgggttcttgcaggtccctgataaacttctcctgggtcccccgggccttttgcgtgcctccggcggcgtgcacgggtccgcagcgaccccctgcccacctctgcccagcccctcccactctgcgggtctgttcagggcccctccgacctcagccttcggggccgggcagtgggtccgccctctgcgtccctggcgctcctgacctctcgcctctccggcctgcaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgaggtgaggtgtggtggcctgagcggagcggccagcggggagggtgtctgatggtggtgacacggggccaggagggcctgagggaggaggccagtgcgtgtgggtatgatgtggtggtctgagaggggaagtgggccttggagagtgcccaatgggggcgacacggggcacggagcatctgagggaggaggctggtgggtatagatgtgatgtggtggtctgagaggggaggcgagtctaggagaatatgtaaagtaggtgatatggcacaaggagagtctgagagaggaggccagtgcatatagatgtgatgtggtggtccaggcagggcagcaggcctgggagagcatctgatgggggtgacatggtgcaaggagggtctgagggaggaggctggtgcgtgtagatgtgatgtggtggtccaagcggggaggcgggcctgggagagcgtctgacgccgggtgacacggggcaaggagggtctgagggaagaagccagcatgtgtagatgtgatgtggtggtctgaggggggaggcaggcctaggagagcgtctaatgcaagtgatatggtgcaaggagcgtctgagggaggaggccagtgcatgcagggcccagggtggctgctgatgggatgtggaggtcagatggaggaggcaggcctagcagaggtctcaagtgagagatggtacaaggaggtttttttgacagaggaggcaggtgggctgtggcgctccaatggtagaggcaggatctcaccctcacgtctgagggaggaggcaggaaggcccttgaggtctcagggggatgagaatgtcctagatggtcttgggcacaacggacggccttgctgggagcaggggtgaggagaggagagggacaggccatcccagccctccgaggagagccaagagagtcctggcaccgctttctgtgaatgcttgttggttgattgactctcagaccatgccagcagaggcctgatgagcctggccctgccagaggggtgtttgccggtggtcaaatgcctgatgttgagaccagctagctctgtggggttgaggaaatccaaggcggcttcccagaggaggaggtgcagctgagctcagctctgcaggatggccaggccacagtgaacaaggagatgccccaggggtcctggcaggagcgtggagatgagaggcctgatgcctgtgcctctggtcccggtgctaagagcagggttggtcctgcagcttcttggctgcgtggccctcttggacttcagtttctcttgcctgccaaatggtggagatgatcagtctgtagctggatggggctatgggaggttccagaagatcatgcgtgtagccacgtgcgaggtgtcagctgcatcccaagacctgagtgggtgcacagcacacccctgccatgcccatccaggccgtgtctggagcacgcgtgaacccccacacacccaggggctgccagagcatgtgggatgggtgtacgccagacgcagacccacacaggtcaccagcccagccccagcccaggcagcactctatagaaacaggcagttgcacagcctgagagggaggggcatttgcccgaacaggaggaccctggggccagactgcccatgctccagacacagcccttcttttccccagctgtatggacacatcccttttctgtgcctcagtttcctccttggtgcaatgggagtaacagccatgccaccttctagagctggtgcaagggtgagacagggtcacgggctcccaggctctagggtgtgtggaaagacagcagggcagagttacccagtgtttttttttttttttttttcctggagacagggtctcgctctgtcacccacgctggagtgcagtggtgcaatctcggctcactgtagcctcgacctcccaggctcaagcaatcctcctgcctcaccctcccaagtagctgggactataggcgcacaccaccacacccagctaatattttatatatatatatatttttttgtagagacagggtcttgctatgttgcccaggttggcctcaaactcctgggctcaagccatcctcccaccttggcctcccaaagtgttagaagtacagcaggcaagagccactgcaccacaccagttacccagtcttttttttttttctttctttttttggagatggagtttcgccctgttccccgggctggagtccagtgacgcaatctcggctcactgcaatctccacctcccaggttcaagcgattctcctgcctttgcctccccagtagctgggcttacaggtgactgccaccacgcctggctaatttttgtatttttagtagagacggggtttcaccatgttggccaggctggtcttgaactcctgaactcaaacgatccactggcctcagcctccccaagtgcggggattacaggcgtgagccaccgcgcccggcagttacccagtcttgatcttgattctttgaccttgaccttagcatctttctcctcccccacccccactgatgagcaacaaacctgctggggttggctgtgagggggcactggggacggtgggggcagagaggtgggccgggtgactgcctgttgggagcaggggccaccgtggggacggaggttctcatcgtcacacagggccagacctctctgccaccacacatcttcctcgcccggggccccgcccccacctcctccgtgctgagctgatacaattttgaagcgagcttttctgctgcagtcagcacaacctctgggcgcctccccacccccaccctgcccctcccgcctctgctcagcaggcaggcctgtgccccaggtcaggttggcctctctgagtgaaggctgcaccctcccttgcccccagcctgcccccttcatccccaagggaatccctgcttcaattggccccagcaggccacaccctcccccaattggccccagcagggcacacccccccccaaccctcccacctgcccactgcgggtgctccagctcctcatgggggtaagagctgggcctggactccaaccccagctcagctgcccactggctgggtgatgtggggccagtcactcaccctctctgtgcttcatttccttgtctataaactggggggctcaaaactggttgccttgtgggaaatgtcaagtgcccagggtgagagctcagtaaaccacccacaaggcatcgtgaagaccaggcactaggcagggggctagggcccttggtggttatcgttactaacattatcctcttcgggattggtttgtttgtttgttattattggtttgggttttttgggggtttttttggttgttgttgtttttttttttttttttgagacagactcttgctctgtctcccaggctggagtgcaatgacgcaatcttggctcactgcaacctctgcctcccgggttcaagcaattctcctgcctcagtctcccgagtagctgggactacacatgcccaccaccacacccggctaatttttgtatttttaatacggacggggttttgcatgttggccaggctggtctccagctcctaacttcaggtgatccacccgcctcggcctcccaaagtgctgggattacaggcgtgagccactgcaactggccttgttttttgttttttgcagagatggggtatcactatgttgcccaggctactctcgaactcctgggctcaagtgatcctcccgccttggcctcccaaagtgccaggattacaggcgtgaccccctgcgcccggcccatcctcctcattctgattataatctcccactgccagacctttccttatgcattccctggacatagaatgtctttcccatatggaaaaccccaactccggctgggtgtggtggctcatgcctgtaatcccagcactttgggaggccaaggcaggtgactctcctgagctcaggcattcgagaccagcctgggcaaaatggcaaaaccccatctctaccaaatatacaaaaaattagccacctgcctggctgaaaattctttcccattctcacagctgccctgtgaggcaaggatcattgctgtatgccttttttttttttttttttttttttttgagatagggtctcactctgtcacccaggctggagtgcagtggcgcgatcttggcttactgcaacctctacttcctgggttcaagcgattctcatgcctcagcctcccgagtagctgagattacaggcgagcgccaccacacctggccaatttttgtatttttagtagagacgggctttcaccatgttggccagggtggtctggaactcatggcctcaagtgatccgccctcctcggcctcccaaagtgctgggatgacaggcgtgagccaccgcgcccggcctgttgtacgcattttacagaggaggaaacagaggctcagaggagggatttgacctgccgtggtcacacagccgagactgggccaggtgggatttggacccacaagcagcttctgcctctgccctgtccttgacacctgcctcatcctccattattgtcagaaggggatgggcggaagttgtggtgcgtgagggggcagtctgctggcacggtgtggtcaccttctggcagggttgtgtgagggccccacaggctgaggtcttatgtagggtccccaggctgtggctggcctccaggcctcagcgctgatcccagtggttgtcaccctgacagcaggaagactggccaccggcttccttttccgaaccgagagtccccttggctgtggagcgtcctggcccagccagagtgcagtgtctggctttcatcagccctgctgggcagctgaggccctgggatagagggagagggagggacgggcatcaggcatagggccttggctggcctcttggaggggtgcagggtggatggcggtggaggggcacctgccatggggctgaaaggagccaccacttgcaacgtcacaagtgagagaggaggccgggcacagtggctcatacctgcaatcccagcacttcgggaggccgaggcaggcggatcacctgaggtcaggagtttgaggccagcctggccaacatggtgaaaccccatctctactaaaaatacaaaaattagccgggcgtggtggcgggcgtctgtagtaccagctactcgggaggctgaggcaggagaatcgctggaacccgggaggttgcagtgagccaagatcgcgacactgcactccagcctgagcgacagagtgagactctgtctcaaaaaataaaaattaaaattaataagaagagggtgtcagggaactgcaggaaaataaagcagggagggacatggaggggggctgggggccactctggatggggagggcttctctgaggaggcgtctttgaggtgaggcttgaagggggtgagggagtctggagaggctgggtggagggagcagtgagggggttatagccagtgcgaaggcctggagcccaggagcagcacatggagctggctgggatgttcagggggtagtgagtggcgagggccgtcctgtggccttccagtgagggtgaccagccgggggtggggcgggagagggtgacccgggtgctctccgacctgccacgtgctggggaaggagcctgcaggaaccagggcccagagagggaagctgtctgcccgcccagggcctaaacccagccaggcctccccgccccctctggcagcccaagaaatctgaggcgcgggcgggcaccgtgccagggctgggcgggggaggggctgccaggcccgcccgtcccagcagctgccagcccgccccgagccgccagcccagatggtgcccatctgctgacgccgccatgggccagcctcctgttcccgccttgcgtcgtgccaagctcctgcagtccagcgccgggaatggcgcggtgggcagagcccggcccgggaagctcatagcacgccagagaggctgccccgggtgccctggagagggtggcaggagaaacatgggagggggagttccccagcgcttcctggatggaattggggagcaaggaccccaacagcgataatgatggcggcaaacacacatggcgtgccctctgtgtgccaggctccgaggccaccgctcaccctaactggtttaattctctcccccatccaagcaggaagggactttggccttctctcgtgttctagtggaggaagcagagacccagaggtttggacaagagtcacttgtccaaggtcacaaagctcctcaggggcagagccggaatgagaatccagaacccctttgaaaaagggattgaggccaggcgaggtggctcctgcctgtaatcccaacactttgggaggctgaggcaggaggatcacttgaggccaggagttcgagaccagcctgggcaacatagcacgaccatgcccccccccaacaaaatttttaaaaatgagccaggtgtggtggtgtgtacctgtagtcccagctactcgggaggctgaggcaggaggatggcttgagcccaggagttggaggttgcagtgagctgtgatcccaccactgcactccagcctgggtgacaaggcaagaccttatctctaaaaaccgttttttttaaggggtgattgaggccaggtgtggtggctcacacatgtaatcccagctacacaggaggctgaggcaggagagtcgcttgaacctaggaggcggaggttgcagcgagctgagctcatgccactgcactccagcctgggcgacagagtgagaccctgtctccaataaaagggaggtggtattgaaaccccttaaacctcttttcaaaaacaaactaaaagtgccctttgaggttatctagtggaagccacaccctctgagtcatacagatcatacagtgcaggccgtgcacactcagggagtaaatgaatgaatgaatgaatgaatgaggtgaaccctatggaaggggaccaagcctggggccagggtgtccataaagctcaccctgagcttgatggcaggagaaagggtctcaacctgggagtgagggacctgggtcagccacagtgctgccctggcttgctgtgtggctttgagaaaagtcctgccctctctggtctggggttgaggggagtggagggtgggaaggggcggccttgtgggccacagacaggagcaaggcgggtcttcactgaaagcctcccgtcctcttctgcctttattgatcttcatcccggttgtgggtgctgcactggggagacaggccatgagctcgggtgacggtgcctgtttatttgtatggtggacagaatttgtgttcctgtgtgctccaggcagtgtggggcgcattcttctctttgagccttagtttttgcctctgtagaatggggagaatcagagctgtgcccattgcattaaagattggagtcagtggtctctgagaagcatacaggaggcactcaataaatgctcacttccggccgggcgcagtggctcacacctgtaatcccagcactctgggaggcccaggcgggtggatcacctgaggtcgggagttcgagaccagcctgaccaacatggagaaaccccatctctactaaaaataccaaaaattagccaggcgtggtggtgcatgcctgtaatcccagctagtcaggaggctaaggcaggagaattgcttgagcccgggagaaggaggttgcggtgaaccgagattgcgccattgcgctccagcctgggcaacaagagtgaaactctgtcccaaaaacaaaacaaacaaacaaaaagaatgctcatttcctccctggattctctccccaaccccaggagggaaggagggaggtcccagtgccgccgtgaaaccctacacctccttttcccaacccagtgagccagtgggggcaccgtgacccaggagtggctgtcaccagaagctggaccaagtcaccctttccaggtgtctggacagcagaggggtgaggggttcctggcagcagcagcctgttatcccccagggctgggcagccaggtgtgccagccgtctgtctgtgcagagaaggtggctgccgggcgtgagtcgcagacgccagctgatggtgtatttatagcaacggcaggagtccgcggggcatacgtcagtggtaaagagggacgggcaggtgggggtccagctcccacagcagacaagagcccaccaggactggccagggagctgaacagagtgtcagggagaatgaggggcatgttgtgcagccgggaggcccaggatcacacccctctgctctggaactgcgtgatgtttgacaagtgacattgcagctgtgggcctcagtttcctcccccatcaaatggggatgataataatcctgcccacctaatagggctgcataggatccaattagtgcatgaaaagcatgaggacagggcctggtatacagtaagcactcaaaagtgatttgttgcctaaaaaagggagggaatcccaacatgggccacaatgtggatgcatcttgaggatgtcacactcagtaaaataagccagacacagaaggacaaatcctgtgtgattccactcctaggaggtccatagagtcgccagattcacagagacagaaagtaggatggggggtgccaggggctggggagggggctggggagagaatgtttcatggggacggggtttcagtttgggaagatgagaaggttctggagaggatggtggtaatggttgtacaaccctatgaatacgcttaatgctgggttaatgccactgaacttagaaatggttaaaagagaggcaggaggattgcttaaggccaggagttcgagaccagcctgggcaacacagcgagacctcatctgtacaaaaaatttaaaaattatctgggtgtggttgcacgcacttgtgttcccatctactcaggaggctgaggcaggaggatcgcttgagcccaggagtttgaggctgcaatgagctatgatcacaccactgcactccagcctgggcgacagagcaagacttgtctcaaaaccagaaccacccccaccaaaaaatggtaaatttatgttatctagattttaccacaatctaaaaatgtagttctggttgtgaataatgataataacaagtaataatattatatctatggccggctgtggtggcttacgcctgtaatctcagcactttgggaggctgaggcgggaagatgacttgaggtcaagaattcgagaccagcccagccaacatggtaaaaccctgtctctaataaaaatacaaaaattagccagtcgtaggccaggcgcggtggctcacacctgtaatcccagcactttgggaggccgaggcaggcagaccacttgaggtcaagagtttgagaccagcctggccaatatggcaaaaccccgtctctactaaaaatacaaaaattagccaggcatggtggcgcgtgcctgtaatcccagctacttgggaggctgaggcaggagaatcacttgaacccgggaggcggaggttgcggtgagctgagattgcaccactgccctccagcctgggcaacagagtgagactccgtttcaaaaaaaaatgttatatatgtaacaatgtaataattagtaatatgtcatatataatcatggaacaataaataagaaaaatagtgtctgcggtgacagcacagtagttattattgtcgttatcatgatcgtcatcactgtggttctcgtccagctctgccctgcagacagctgtgtaaccctgggtgagtttcttgccagctctgtgctttactgcctcatctgtgaattgagcatagggggtgcctagcaatttaaatgagataatagctcttttttttttttttttttttttgagatggagtcttgctctgtctcccaggcaggagtgcagtggtgtgatcgtggctcactgcaacctccacctcccgggttcaagtgattctcctgcctcaacctcccgaatagctgggattacaagctcatgtcaccacacccggctaattgtggtatttttagtagagcgggggtttcactatgttggccaggctggtctcgaacttctgacctcaggtgatctacctgccttggcctcccaaagtgctgggactacaggcgtgagccaccgcacccggcctaaatgagataatatctatgaaaaaactaaccctttgcatgtgatgagtgctgggaactggtaggctctttgaggagtaggtcctcccaccaccccgcagacgcccctacccagcagaatgctggtttctgcatgaatgcatttgtgtggggactcccgagacagcccctgagggagccctcattcacccgggtggggcccggccctcccagagccagtgggagggggaggcgccttgttgcacctgtgatgccccccgttatggctgggctgcagttgtcaccctggccctgtgcctgggaagccaaggggaggctgagggcagctagggacagctctgtgcccacggccccctccagccagctgccaggccagccccctccctccagctgggcgagggcaggaagtcacagatggtcagggttggtgaggggtgaagcagagggcatttggggacaccggatgtctcgtccagatggggaaactgaggcccggagaggggcgaggcattgccccgagttgcccaggaagggccttggctcttgtcccttctaagtcccatctttatttttattttttattttttggagacggagttttgccctgtcgcccaggctggagtacagtggcgcgatctcggctcgctgcaacctccgcctcctgagttcaagcaattctcccgcctcagcctcccgagtagctgggattacaggtgcccgccaccacacccagctaatttttgtatttttagtagagatggagttttaccatgttggccaggctgacctcgtgatccacccacctcggcctcccgaattgctgggattacaggtgtgagccaccgcgcccagactaagtcccatctttaggtccgcttggctgttccacggccacctggaggggaggtagggccagcaaggagggaccctagggtctcagggcagaagatctgccggaggagagggagaagggggttctgaggggaggaagacgcgagaatctcaacgctgaagtggtttctagattctccagggcatgagtcctgaaatccccaaggcctgagttctagaatttcttccactggggccctgaccacacaggtgattctagaattctcctaggtgagttccagacccaggggtccaggagaaatagaatgttggctgggcgtggtggctcacacctgtaatcccagcactttgggagaccgaggagggcagatcacttgaggtcaggatttcaagaccagcctgaccaacatgatgaaacccggtctctactaaaaatacaaaaatgagccgggcgtggtggcgcgaacctgtaatcccagctactctcaggaggctgagacaggagaatcgcttaaacccaggaggcagaggctacagtgagctgggatcgtgccactgcactccagcctgggcaacagagtgagactctgtctcaaaaaaaaaaaaaaaaaaaaagagttccaaccacacatataatttaacatttttctggtcctcacacttaagaatgtaaatttaagtatactggggaaattaattttaacattattttaagtaatgttaattttttttttccttgagacagagtctcgctctgtcgcccaggctggagtgcagcggtgcaatctcggctcactgcaacctccacctcctgggttcaagcagttctcctgcctcagcctcccgagtagctgcctcagcttcccgagtagtaacattaaaatgtttaattttaacattactttatttaacccagggcatctggaatgatactattgcaatccataaacaacaggaaaaattattggtctattggtcgggtgcagtggctcacgcctggaatcccagccctttgggaggctgaggtgggaggatcacttgaggtcaggagtttgagaccagcctggccaacatactaagaccttgtctctacaaaaaaattaaaaaattagccaggcgtggtggcgtgaacctgcggtcccagctactcaggaggctgaggtgggaagatcgcttgagcccaggaatgtggggctccagcgagctgtgattgtgtcactgcattccagcctgggtgacagagcaagacttcaactcaaaaaaaaagttatcgaggtattttatgatcttttccccacccaccccccacccgcttacactaagtctgaaatttggacagaccacatttcaagcactggatgtcacacgtggccaggggctgctgtattgggcaggccgtgctaagacatctgagttccagagcaggggttcccgacccccgggccacagacgggttccgtgcctgggaggaacctggccactcagcaggagttgagcttagggcaagtgaccattctcacctgagctccacctcccgtcagatcagcgggcggctctgggtgcccctacgagcatgaaccccatggtgaactgaacataggagggatccaggttgcgtgctccttaggagaatctgactaatgtctaatgtctagtttcatcccagaaccatctccccactcaccccgtccctggaaaaattgtcttccatgaaatcggtccctggggccaagaaggttggaggctgctgttccagagaattcggaagcagatctccagtctcccaagttgggttctcgaaaacgtgagggcaggttctagaccttccaaactggttgcttgaaaatccaaggaggctgggcgcggtggctcacacctgtcatcccagcactttgggaagccgagacgggcggatctcccgaggtcaggagttcgagaccagcctggccaacgtggtgaaaccccatctctactaaaaatacaaaaatcagccaggtgtggtggtgcacacctgtaatcccagctactggggaggctgaggcaggagaatcacttcaatccgggaggcagaggctgcagtcagcagagatcgcaccactgtactccagcctgggcaacagagtgagaatctaactcttttgcccagactggagttcagtggtgcaatcacagctcactgcagccttcaactcccaggttcaagtgatcctcccaccttagcctcctaagtcgctggggctgggattacaggcgcataccaccatggttgattttttttttttttttttagtagagatgaggtctcactatgttgcccaggctggagtgctgtggtggactcatagctcactgcagcctcaatctctcaggctcaagggatcctcctgcttcagcctcccaggtagctggcagtataggcgtgcaccactacgcctggctgattttttatttttatttatttatttatttactttttgagacggagtcttgctttgtcacccaggctggagtgcagtggcgcaatcttggctcactgcaacctccacctcccgggttcaagcgattctcctgcctcagcctcccgagtacctgggattacaggcgcgtgccaccacaccggctaatttttgtatttttagtagagatgggatttctccatgttggccaggctggtcttgaactcctgacctcgggtcccaaagtgctgggatgacaggcatgaactaccatgcccggccttatttttatttttcgtagacaggaggtctcactatgtggcccatgctgggatttcaggctctttgagctttcttccatattggttagggctggagcaggactccactgtggcgggaggtatttgggcgcaaggagagcagttgtgaggactggtggtgacccccagttactgtctgttgtgctttggatgctgggcacgggaagcctggctgtaagtgtgtgtttccgggccgggcgcggcggctcacgcctataatcccagcactttgggaggctgaggtatgcggatcacgaggtgaggagatccagaccatcctggctaacgtggtgaaaccccgtctctactaaaaatatgaaaatattagccaggcgtggtggtgggcgcctgtagtcccagctactcgggaggctgagagaggagaatggtgtggacctgggaggcggagcttgcagtgagctgagatcgtgccactgcactccagccggggcaacagagtgagactccgtctcaaaaaaaaaaaaaaaaaaaagtgtgtgtttccaagaggctgttatggggcctcgggcacaccctcactgggtctggatcccagcctgtctaccaccaggcgtcccttctggtgaacagagctatgtgagaacttccaacagggacaccacggccgctcgtagcccagagcttgcagagctttgttcaaaggcaatggcccagggccgagcacggcggctcacacctgtaatcccagcacttgcagaggccaaggtgggtggatcacctgagatcaggagttcgagaccagtctggccaacatggcaaaaccctatctctactaaacctacaaaaattagctgggtgtggtggcacatgcttgtagtctcagctactcgggaggctgaggcaggagaatcgcttgaacccaggaggcagaggttgcggtgagctgagatcgcgccattgcactccagcctggtgacagagtgagactccatctcaaacaaacaaacaaacaaaaaagcagtggccatcatgatcggttgtgtcatctagtgggaggcaggggtgtgtctgcatgcgtgtctggggtgcattgtggggggattgcaggcgtattgagggcttaccaagtgcctggctcatctgagccctcaggaaaccacattgttggcagctacctcaccgtctcacaaccacccgctgaggttggaatgatcattaacagcatttaacagatggggaaactgaggcctagagaggcaaagtcactggcctaaggtcacatagctaaggagcacagtcaggatttaaatccaagcctgggagatcccaggacccacagtgggcaccacataaaggggctgtttggggtatggcagggactgccctggaacgttccggatcctgcctttgggcctacagggctttggtgccggtgagcaggccgcaggttcagctggctcaaggagcagcttcagggctgcagccaggctgggggctgggcaggtctcaaacccctggacctggggaatcagggaggtgtgagctgcatctgaggtcgggtgtctctgtgactctgtctctgtctctctacctctgattctccccaggctgccttgtctcagtccctgtctattcccaccccacctcgctctctctcccggccttgcgagtctcctcccagccccccatcccacccagtgggctgcccggaggtggcggcaacggggcagctgaatgggcctcttgttcctggccacacccgccccttggggtcaccctgggacatgcccaggcagcgtggctaccttaaagggccagtgctcagaaagaatgtgagcgggggaggctgcgtccactcccaaatcccacaccctccccaaggtggaccactcatgtgtctgacgggggtggggagctgtgtacctacacaccctcgtggcttgggggaggcctgtctggagcaggagatgtgatagggtttgggtttgaccttggataaatcccttcatctctctgtgcctcagtttccccatctagatcagggggctccttggtgccacccctgtgggttgctgggcagatggcatattatccaggattttgcacacagttgacactcttccggcgcccactgtgcattgatagagcacctgctgtttcagcccagcattcatccgccgtgcagacttggcaattccttcttcaccttgctccgtgcctcagtttccccaaatgcagaatgaggcgatggctgtcttagcttcacagagagctacgcaaggattgagtcggttcgtggaattagagggtattagggagaagggcctgaaacactgccaagtgtcacctccactggcgcacttattgagcgccagctgcataccaggccttgctgaggaagcctcactgcagaggttgcagtgagctgagaggcaaaggccacccagcctggatctcactctggtgtcatcgcctcctccctctgctcagggttgtgcagcttcaggctgctcccctgccctctctgggcctcagtttcaccttcagagcaacgggaacagccccatcctttcacacactggaaaccatcaccttcttctgcctgggagggggttgtgctgtctctgggaatcccaggcatcccccaggcaggagtcaacccagaggccctcggacccgggctgtaccctgtgacagctccgggtggctacgacgctcccgtgctccaggccagccccacagacagcccgggacaggttgctgccggatggacaagcctgtgcctcgctgccttatgtaaccagtttatgcaagggcagccggcccgcttacataaggggaggccgggccagcgcccagctggggagggggaggctcttaaagggaccggcgtcccccgcggctccctccacgggcactggtgcgaattcataggcgagctgcggactccgccctcagcaaggccgccattaatgtcgttatgattatttttgtggatgttgtttatcatcactatattctttccccagggcgggggttcagctgagcggaggaccacgcccagtgcttgggcagaggcttgggctgtgacgctggctctgggtgtcacctggttaagtccctgtctctgagcctcagcctccccttctgcacagtggggcaatgcaggaagacgtgaggtcctggagggtcctggccctgctgcctgttcactgtgtggcctcaggcaggtggcatcccctctctgggcctcagtttccccatctataaaatagcgcctgctctgtggggttgctgagggagagtcaataagacatattaagagtttacatgcccgccaggcatggtggctcacacctgtaatcccagcgctttgagaggctgagacgggaggatcacttgaggccaggagttcaagaccagcctgggcaacatagtgagatgcccatctctacaaaaaataaaacttagccaggcatggtgatgtgtgcctgtagccccagccactcgagaggtcgcggcaggaggattgctcaagtctgggaggttgaggctgcagtgagctgtgattgggccactgcactccagcctgggtgacagagcaacaccctgtctcaaaaaataaaaataggccaggcatggtggctcatgcctataatcccagcactttgggaagccgaggaagacagatcacttgagatcaagagttccagaccagcctggccaacaaggggaaaccccgtctctactaaaaatacaaaaattagctgggcgtgtggtgggagcctgtaatcccagctactggggaggctgaggcagaagaatcacttgaacctgggaggcggagattgtagtgagccgagatcgtgccactgcactctagcctgggtgacagagcaagactccatctcaaaaaataaataagtaaataaaaataaaaataggctgggcacagtgactcacacctctaatcccagccctttgggaggctgaggcgggaggatcgcttgagcccaggagtttgagaccagcctgggcaacatagcaaatctctgtctcaaaaatttttgaaaacaaaagagtttaggacagcacggagcacagacactgtcagcactcatccagtggaaccactttgcagccaataaatatttagtaagctcctactgtatgccaggcactgctccaggcgctgggatactgcagtgaacaggacagataaaaattcggccctggccaggcacggtggctcacacctgtaatcccagcactttgggaggctgaggtgggcggatcatgaggtcaggagatcgagaccatcctggctaacatggtgaaaccccgtctctactaaaaatacaaaaaaaattagccaggcgtgatggcaggtgcctgttgtcccagatcctcaggaggctgaggcaggagaatggtgtgaacctgggaggcggagcttgcagtgagccgagatcacgccactgcactccagcctgggtgacagagtgagactctgtctcagaaaaaaaaaaattctgccctcgtggaactcacagtttggttcaggcgatgggcaaagaacaagaaataaatgtcagtttaggcttagtgcggtggctcacgcctgtcatcccagcactgtggggggccgaggcgggcagatcacctgaggtcaggagttcaagaccagcctggccaacatggtgaaaccccgttcctactaaaaatacaaaacattagccaggcatagcggtatgcgcctgtaatccagccactggcaggggctgaggcaggagaatcgcttgaacccggaaggcggaggttgcagtgagccgagattgtaccactacactccagctggggccacagagcgagactccgtctcaaaaaataataataataaaaataaaaagaaataaatgtcagtttagcgataaggactatcaagaaaaataaagaaggccaaaggaaaagaggctgatgggctgtgctggggaggtccctgaaaggctgtctgaggacctgacatttgagctgagacctgagaagtgaggaggaaccagttatatgaagaactgggggaaggcgttccaggcagagggcacagcccgtgcaaaggccctgcggcaggacacacctggcactttggaggaacagtgaggaggcctgtgtggctgcagcagagtgaggagaggaagagaaggaggaggggagggcagtttgtgcaaggcctggtgggcagtaggaaggacttgggctttgaccccaaggcaggtgggagccatagagggctatgggcagaggagggaccagccctgactcaggtgctcacaggcaccctctgcctgctgcagggaggacagactgtggggggtgagggcaggagctggggaccagggcagagtggaccgccctggtgcaagcaggcggtagcagggacagaggcagaggagggggcagaatccaggtcaactccgacggtgtgaggattcagttgctcacctgggtcgtttataccttatctgaggctggcccttgctctccttgccccgtctcctgcctgcaagccgcacctgcctgggcacatgcagggaagggagcggcgcagcactgggcacgcctgggagctctcctgcaatcaggactttgttagcgggcaagctgggatatgggtcctggtgcccgggaggcccgtggggctctgggctcctgccagggtcccagccctaacccaggtacgccacccacatggcagggttattctctttttttttctctttttttagacagagtctcgctctgtcacccaggctggagtgcagtggtgcgatctcagctcactacaacctctgcctcacaggtttaagagattctcctgcctcagcctcctgagtagctgggactacaagtgtgcaccacctcacccagctaatttttgtgtttttagtagagacggagttgcaccatgttggccaggctggtctcaaactcctgaactcaattgatccaaccgcctcgacctcccaaagttctaggattacaggtgtgaaccaccgtacccagcctattctcatttattttctttcttatttttttttcttttttttgagacgaagtctcactctgtcacccaggctgaagtgcagtggcacgatctcagctgactgcaacctccgcctccagggttcaagcaattctcctgcctcagcctcccaagtagctgggactacaggcatgtgccactatagccagctaatttttgtatttttagtagagatggggctttgtcatgttgacgaccaggcaagtctcgaatgcctgacctcaggtgatccacccagcctcagcctcccacagtgctgggattacaggctggagccactgcgcccagacggtccttccttttcatgcctcctccttccactcccccatgtaccatgtctccttgtctctctttttctctctgctcatccctccctctcaactttctttctacaaatatttattgagcacctagtctgtatcaggccttattctagccactgagggcacaacagagatctagacagacaaagcctctgccctcaaggaggtgacattccactggggagatgagcaaacacccgtgcagtcactaagcaactaagcaaatccataggcaatcactaacttcctctgaaggaaagaaaacagaaggctgagattgagggtagccagaggctgcttgaggtgaaggggctcagcgtagacctctctgagaagggagcatttgagctgagaccaggagagatctcaagagagagcaagcagttagctgtttagacagagggaacagaatgtgcaaaggccctgaggcaggactgggccaggtgcattggaggaacagcgaggaggcccctgtggctggagcagagtgagtgagggggagagagggaagaggggagggcagaaagcggacaggacaggttgtgcagggcctgtggtcctagtcctccactttgactactcccccaaatctcttaatgttcctcacattcctttccctgacaagcatttattttgcacctgctgtataccagatcctatcaggagaatcccaaatattcatgcaacaagttcatattgggtgcctactgtgtgccaggctctgctggaataatcacactcatttggctgcaggcatttattgagtgccagctgtgtaaaagcatttatcgagcaccacctgtgtagcaggctctggggagagaggccacatgaaagcttgggaaggagaaagtttccttctaccccctttcaggtttgtgccctctggtttccagccccctcccacattcaaggcaacatttaaacctctgggttcaagttccgttgtccaactgcgtggccgtgagatctgcggcaagccccttcctctctcggatcttccgtttccccctttgtaaagcagaacactccacaatctgatgtgtttacaacttgacatctactttttgcagcaagggaaactgaggcacagagcagggcggagatgtgtctacctctccctccccaagcaagactggcatggagtctattctcctgaccccacgccaaagccagggcgtttggtattttgttttttcttggaggcccagagaggggcagggcttgcctgaagccacacagcaccgggcaggcctcggaattgcggagagccctcccctgggcgcctgcccgggctcccgcgccttcctcctgcctcctttggctgggccgccagccttgcctcccgtcctccggactccccgcgggctgcccagttggagacgcgccccaagaaatatcagaaggaaggggaagccgggaggggcctccgcctcctcccgccaccccccgccgcgcccggctgcccccacccggtgcccgacattggcagagagtgtcctcgggcgcttccgactggccctgcctgcttcgtgtggccactgatcccttccggagcctctccatggggacgcccgtgtgtgcgctcagccagtggcacatgtggctcccggggctcccttctccacccccccagcccctggcctgcccctttccccccatcccttcccgaacctctccatggggacgcgtgcgtgtgcgttcagcccgtgggcacatgtggctcccagggctccccccgaggcctgcccttctcccccccccgtcacagccgccgagtcaggcctgccaggaaggtgttgggggtgggggtgtggggaggcctcagcttggctgctgggaagccaagaatttgctccaaatgtaaacagcgagttattttcagtccactcccccccaccccgggtggcgttgacacatttgacattggcgggaccgggagggggtgggggtgagggtgtgcgtgcgggtatttttaaccttgctcctcacatccctggagtggctggtgccgagtggcagataatggggagggggcgcggaggcgtggggagccctgggtggccgtgcgcgggtgggcgcttggcaaggccgccctgctgttggcaccacgtgtttaacccctcagaggctgcagaggggctgggggaggcggcccagggcccagtggtgccccagaggctcccttgtcaccttctcctggtgtccccccacccccaccccacccaggagggcagggccgggtgcccgaggccggtgccagcctgcgccgcccagacctacaaaatggccgccaaggccggagaaacatctggaacaggggaagggagaggcgagaaaatggccgccagagggatgatgtcatgggcggcgtggcctcccagagcgtccccagcacggggcgagtccctacgcgcaggcctccgagcaggggccctgcggcctccagggacctccagacccgctgcccaggccggacacccacaaagagtgacaccggggtccccaggggtccccagaggcgggcccgagacctgggggagggcgaggccagcactgggcctccagtcccaacagcccgatgctggggacggttccggggcggtggtggccgctgacctgacccgcaggacaccgaggcgtccaccagcgcccgggagggcccggagccaggccatggagccggcgggggccgggtggaaagaaaaaagaaacttttctttgaaagtgattccgaagcaggttggctccggcccaggcggcccggcggcaggggagagggagatggaaagtatgggccagacttaaggaacgcaggaaggacgaggccggggaggcccgggatggaggccagcgtcctggaggtcaccccgtccacgcctctgcctctcgggcccccccaggtcacatccagattttcctccctgtccctggggcgggcggggagtgcggagaacatctatgggcttgtgttttttcctcttttgatttgtccagacaggcgatggacaagggctgggcaggggttttaggtcatctgcactgtcaggatgtggaggctcagagagggagagtgcttttagtgaggtcacacagcactggcaaaactgacagctgcttccctccttagagcatcttggggaggaggaagttctctatggaggatcagggtccgtactggaattcctttctatttttatttaatttaatttatttatttatttatttatttttgagatggagtttcactcttgttgcctaggctggagtgcaatggcacgatctcggctcactgcaacctccacctcctgagttcaagcgattctcctgtctcagcctcttgagtaactgggattacaggtgcctgccactacacccagctaatttttttgtatttttagtagagacaggggtctcaccatgttggccaggctggtctcgaactcctgacctcaggtgatctgcctgccttggcctcccaaagtgctgggattatacgtgtgagccaccgcgcccggcccctttttctttttctttcttcctttctttttttgaaacagagtcctcctgctctgtcacccaggctggagtgcagtgacttgatcatggcttactgtagcctcaaccttctgggctcaagcaatcctctcacttcagcctcctgagtagctgggaccacaggcatgtaccaccatgcccagctaaatttgggttttgtttgtttgtttgagacagagtctcactctgttgcccaggctggagtgcaatggcacgattttggctcactgcaacctccacctcccaggttcaagcgattctcctgcctcagccttccaagtagctgggattacaggcacccgccacgatgccctgctaattttttgtgtttttagtagagatggggttttgccatgttgcccaggctggtctcgaacttctgacctcaagtgatccgcctgccttggcctcccatagtgctgggattacaggcatgagccaccgtgccctgcctatttttttttttttgtagaaatagggtctcactatgttgctcaagctggtctcgaacttctgacctcaagtgatcctcttgccttggcttcccaaagtgttgggattacagcgtgagccactgtgtccagccaatgtctgtgtgtttttcactgctctgtccccagtacctaggacagggcatggtacacagtaggcgctcaagacgtgtgttggataaaagcatcacagttttctcctgaggctggggttggcacagatgctggcacaggaagggggcagaggctcaggaaatgcaaagtaggttgcaacgtaactggacacacacgggaaccctgtggtcacatttttcaggagggatgtgaggaggcgaaaactcaaacttccctcacttcaagtgcagattctgtgccgggagctgtggacgataaaccacatttgaacagaagcctgaataaagcgagagagtgagccaggcaggcatttgcagggacggtgttccaagcagtgtgcacagcccgtgcaaaggccctgaggcaggaccgtgcctggtgcattggtggaacagccaggaggcctgtgtggctggagcagagtgagcgagggggagagagggacgaggggaggaggggagggagggggcagaggcgggctgtgcagggccttgagcgccatggggagatggggagaacttggacttttagatatttggttttctgttttttgttttttgtttttgaggtggagtctcgctctgtcgcccaggctggagtgcagtggtgcgatctcggctcactgcaagctctgcctcccgggttcacgccattctcctgcctcagcctcccgagtagctgggactacaggcgcccgccaccacgcccggctatagttttgtatttttagtagagacggggtttcactgtgttagccaggatggtctcgatctcctgacctcgtgatccacccgcctcggcctcccaaagtgctgggattacaggcgtgagccaccgcgcccggcccaattgtttggttttgtttttgctttgttgttgttgtttttgagatggagtctcgctctgtcacccaggctggagtcactggtgcaatcttggttcaccgtgccctctgcctcccgggttcgagcaattctcctgcctcagcctcctgagcatctgggattacaggcatgcaccaccacgcctggctaatttttgtgtttttagcagagacgaggtttccgccatgttggtcaggctgagctggaactcctgaccttgtgatctgctcgccttggcctcccaaagtgctgggattacagacgtgagccaccgcgcccgggtgaactttcacatatttgtagacccagacacagtccagggtgctggggactagaacaaacgtttgcagaaagggctggggagggtgttccagagaaggagatgtcagagctgggctgcaaagtatggctggaggtttcctaggagggagaggggcagggaagacggcacagcaggagctcagaggactcaggcccaggtcactcgtatattccattgccttccaggacagagaaagttgaaccttcgccgggtaatgtttaaaaatggccggtgacacccagtagctgggaattccagggcctggctttggttctctctttagctggctgaggttgggaggcggacgtggcagccggcagagccagcaacatttggaagccggctaacgttggaaaatcaaccaggcgagctcacggtggcggccgatgctggaaacctgggctccgtgaggtccagcagatgccctgctggggcccaagtggacattctaggccttctgacagcccgccgggtttttaaataagtgtgattatggtttcagcaagtcctgtccttcctacagccaaaagatcaattcaatatggccactccgtgcaatgctgggccacccctgctgggccagggtgttgtgttgaagccaagattcccaacacctgagagtccagaagtttctttaaaaattgctttaactgtggtgagacacacatcacacactttttttttcttgagacagggtttcactctgtcacccaggctggagtgcagtggcactgtcatagctcatcgcagcctcaaactcccaggctcaagcaatcctcgcacctcagcctcctgagcatctgggaccacacatgcagcacgcaccaccacacccagctaatttttattttattttattttatttttgagacggagtctcactctgtcgcgccaactcggctcactacaacctccgcctcctgggttcaagcagttctcctgcctcagcctcccgagtagctgggactataggcgaccgccaccacacctggctaatttttgtatttttagtagagacaaggtttcaccatgttgaccaggttggtctcgaactcctgaccttgtgatcccaaagtgctgggattataggcgtgagccaccgcccctggctgacacccggctaatttttaaaaatattttgtagagatggggtcttgctatgtggtccaggctggtctcgaactccttgcctcaagtgatcctcccacttcagcctcccaaagtgctggaattacaggtgtgagccactgtgcccggcccagagacttttgaaagtctaaaatggattgtatcatagctcacatcactcctcttcccactgcaggataaaacccaggcctctcactgcaacacacaaggccccgaatggtcccgctcccctctccgttcgttcctctttctcttgcccaccacgctgcagcctggggtctgtctctgcctttcacacatccaacttcattcctgccccgtggaccttgcccttgtcaccgaacctttgtggaacgctttcaccccagctctccacatggctgggctccttctcccgctggagagccaccgtcacatcctcagagaggttctgcctgagtcctccctccaacgccgcccccaaagccattctgccttccgccagtttcattgcctccgtagaacctagaaccgtgtgaaatgatctgaggcttcctccatgcactggttctgcccgtctccctccccacttccttctctgccatccccccaaggcctggcgagtagtaggtggtcagtaaacacctgttccgtgagtgccgggtgtgcgttgacctcccagtcaccaacggcggaagcttcagccagcggacgcagggagttgtcccttgcaaagggggtgggtgctcccgggcgggaagggtggggccagagcccacggcgatgcctttgtcatgagctaggatggactgaatttgggctcacagccacggacaggagagaacagtgtgtccgccccgtcagtgccatccagcgtgcgtggctgttgtgcatcatttgtttgcttgagcaaaggctacagggtccagtgacattcttggcagtccatgacacctcacagacctgggaagtcaagagacctggctcccggccagatgagggtatcatttgaaatacaatttgctggccggctgcggtggctcgcacctgtgtttcccctactttgggagacagaggtgggaggattgcttgagcccaggagtttgagtccagcctgggcaacatagcgagactgcgtctctactttttttttttcctgagacggagtctcgctcctttgcacaggctggagtgcagtggttcgatctcggctcactgcaagctccgcctcccgggttcacgccattctcctgcctcagcctcccgagtagctgggactacaggcgcctgccaccacgcccggctttttttttgtatttttaatagagacggggttttaccgtgttagctaggagaacaacaatttgctttccagaaccagagcctctcaacactagcatgtgtgtggtcatccatgctaaatggtgctgaaagaggcatttgtgtctctctgagaaggagctatttgaggaaagtcctgaatgaggggagagaatgagccatgtagatagctgagggaacagtgttccaggcagaggcgcagcccgtgcaaaggccctgaggcaggaccatgcctggtgtgttggaggaacagcgaggaggcccccgtggctagagcagagtgaggaaggggagacaggaaggaggggagggcagggaggggactgatcgggccatgcagggccttgtgggccacgggaagaaggtgggcttttccccgcaaagaaggtgggagctatggagggctgcgggcagaggaggggtaatgttcatttaactcctggagtttgacaaaatgctatcatcaaaacagactttatcacagaacctctagctatccccgtcccctccgtaagctcctctgagcatagcaacagaacgggaaggtaaggcagcgattggaaacgcccgcgttatagatgagcggagagccgctggaggttggaggctccgacagaggaggtgactggtccagagccacatggccaggttgtgctggggctggaactccatcgaacgcaggtttcagggtgcagcccttgtttccataagataccccaaaatcagacaagcctgggacttgccacctcttctttaaaaaccccagtgctgtttttgttgttttttttgagatagggtctccctctgttgcccaggctggagtgcagtggctcaatcatagctcacccactgcagccttgacctcctgggctcaagcagtcctcctgcctcagcctcttgagtagctgatactacaggtgtgcatcaccacagccaggtaacttttttttttaaagtagagatggggtggggtatcctgtattgcccaggcttgtctcaaactcctgagctcaagtaatcctccctccttgaccttccaaagtgcaggaattataggtgtgagccaccatgcccagccctccagtgctttttttttttttttttgagacggagtcttgctctgttgcccaggctagagtgcagtggcacgatctcggttcactgcaacctctgtctcccgggttcaagcaattctccttcctcagcctaccgagtagctgggactacaggcacacaccaccatgcccggctaatttttgtatttttagtagagaccaggtttcaccgtgtcggtcaggctggtctcgaactcctgacctccagtgatctgccctccttggcctctggggattacaggtgtgagccaccactcccggccctccagtgcattttaaaggctctgaaaagtcctacgttgtcctgaaaactcctcagtgatgctgaacctttttgacctgtgaaccccaggtttgggtaaagtctgctcacatccggcggcacacccataggaaacccccagcccggctgtgaggagtgtgaactttgattcaccaggtccttggcccagctttagtttctcccgtgtccgtgtttgcttgtgcaatcatgaatatatattgaccagcaccaggtgccacattgaacagtttgtccgcgccgtcagtgccatccggcatgcacggctgttgtacatcatgtctttgcactggactgagctcagctgcagaaagcagcacatttcagagggtgtctaccgggccaggagaaaacacacaaaccgccaacattttaaagcctgtaatcgacatcgtatacaattggaaaagatgttcatttatatgttttgtttttgttttcttaagacagggtctcagtctgtcacccaggctggaatgcagtggtgcgatcatagctcactgcagcctggagctcctgggctcagacgatccacccacctcagcccccagagtagctgggactgcaggcacaggccaccacgctgggctaatttttagatttttgtagagatggggtcttgctctgttgcccaggctggagtgcagtggtgtgatcttagctcactgcagactcaaactcctggattcaagccatccccacctcagcctcccaagtagctgcgactacaggatgtgccaccatgcccagctaatttatttttatttttatttttgctagagagagtgtctccttatgttgaccaggctggtcttgaactcctgacctcaagcaatcctcctgccaaggcaatcctctcaaaatgcagggattacaggtgtgagccactgtgcccagcctgttcatacgttttaaagagaggtgcagacaaaactgggttggtgcatccacatccctctctgtgtgatgctgggtaatttgcttaccctctctgggtatcctggagattgtcagccccagccaaggatggttaaaaggcattaaacaatacctaggacagagcctgacatctggagctcattaaaccatccgtacatgcagatgtcgttataattattatcaatgctattctgtcactccacaccctgactcccacctcagtggccccaggtgggggtgctctgaaatttctctggcctggctgagcgggaggggccggggttctgctggaataaagaacagaggaggaagccttgaaggatttgttctgtcccagctgtccccagtatcacagttagccacacggatggcagaagggacctttgacagtggacacaggggctggaagggcccagcctggggctcactgcaatctccgccttccagattcaaatgatcctcctacctcagccttccgagtagctgggattacaggtgtgtgccaccacacccggctaatttttgtatttttagtagagatggggtttcaccgtgttagccaggctggtcttgaactcccgacctcaggtgatctactcacctcagcctcctaaagtgctggaattacaggcatgagtcaccgtgcctggccttggggctttatctgactggctagagaatgggattcaaacaccaggaatcatcccaaaccgccaatgagaaggagccctggagtgaggggaaccgagacccctcctaaaaggatttacagggtgtcacagaatcaaaattacagcaaaggctcaactgtgagatgccagggtggctgatcattgattctagacccatcactaccagctggtgttctgtgagtttgaagccattgctgtctagctttgtgcctcagtttccccagctggcgattaccgtcccccatatggggacggtaatcacgtgtctgctgcagaggagttacaaagatttgtgaggcaatggaggcaacatttgcagccgaacctagtcaaaggaattactcactgcgcattaatttgttgttttttgagatggagtctcgctctgtctcccaggctggagtacaatggcgcgatcttggctcactgcagccatcccccgggttcaagcaattctcccgtctcagcctccggagcagctgggattacaggcacgcaccaccacgccaggctagtttttgtatttttagtagagacagggtttcgctatgttggccaggctggtctcaaactccaggcctcaggtgatcctcccacctcagcctcccaacctccctagcatttcaacgacctgaagtgaccctcttgatttattttctgacttgttcatttcctgtcacgttcccattagaacatcagtgcctcgagaggagggattcttgtctgtctctgttgccgctgtgtcccttgggcgtctggcatccgggtggctctctgcaatctgtttgctgagtgatcaaaggaaagaactaatggcaacatagtgcagctccaatgtacagatgaagaaatccaggctcagagatgtggaagtacttgcccagggccacacagccggaagcccgccaactcttttagtaaagggccagtgacactgtaaacattttaggcttttaggcaggtcacatgcagtctctgttgcctattttttcttttgtttacgaccctttaaaaatggaaaagacaggccgggcgcggtggctcacgattgtaatcccagcactttgggagtccgaggcggacggatcacgaggtcaagagttcgagaccagcctgaccaacatggcaaaaccctgtctctactaaaaatacaaaaattagctgggcgtggtggcacgtgcctgtagtcccagctactctggaggctgaggcaggagaatcacttgaacccgggaggtggaggttgcagtgagccgagatcacgtcaccgcactccagtctgggagacggggcgagactgcatctaaaataaaataaaataaaataaaataaaataaaataaaataaaataaaataaaataaggaaaagaccatacttagctgactgtgcaagaataggcaaccccttctagtttgctcatctaatgtcagaacccacgaactgattccaaaaccctccacagagaatctaaaatgctgcaaaccccgactctgtgatgctggggatctaaagtgcttagtttgtttttttgtttttttgttttttgtttttttgtttttgtgttttttgagacagaggctcgctctgtggcccaggctggagtgcaatggcatgatctcggctcactgtaacctctgcctcctgggttcaagcgattctcctgcctcaacctcccaagtagctgggattacaggtgcctgccgccacacccggctaatttttgtatttttggtagagacggggtttctccatgttggccaggctggtctggaaatgctgatctcatgtgatccaaccgcctcaggctcccaaagtgctaggattacaggtgtgagccaccgtgccctgccaagtgcttggttctttagtctggagtgcagtggtacgatctcggctcactgcagcctccacctgccaggttcaaacaattctcctgcctcagcctcctgagtagctaggactatgggtgcatgccagcacacccagctaattttttttttttggtacttttagtagagatggggtttcaccatattgtccaggctggtcccaaacccctgacctcaagtaatcctcctgcctcggcctcccagagtgctaggattacaggtgtgagctctactgcgcccggccaagtgcttggttctttctcgactcaatcctattttgttctacacaggtcaggtctgcctccactcccccaaccccatgccccatttcacccattggcctctgaagcccagagatgggcaggggtttgtctgagaccacacagcaagaggggcagcagaggaggatgggaacccagatctgcttccctcccaggctacacccctgtagccccccaacccctgcaaacttgttatttaagcctcctcattacaggggtttggagccgaggaagccctgctgccttttcgtaaatgctctccctagacagcaatctttgatggaggctctgggagaagttgttcagtgatgtgcatttgtcgagcacctactgtatacctggtgccagtatagggttgggtggaagggtcttgtccactcaacacccctttttctgccctattattgccttccctggccaggcgaggtgactgacacctgtaatcccagcactttggatggctgaggcaggaggagcgcttcagccctggagtttgagttcagcctggccaacatagtgagacctcatctctacaaaaaaatgtttgttaaaaattagccagatgtagggccacaagcctgtagccccggctacttgggaaaagaaggcaagagaatcacttgagcccaggaggtcgagcctgcagtgagctatgatgacaccactgtcctccatcccgggccacagagtgaggccctgtctcaaaaaaaaaaaaaaaatcaagaccatgattgcccccccataaagagcccttttaaacattttttccctaatcactctcctgtgaaattttaatagcataggtatattttatatacctatatatattaaaaatgtacctgtgccatcaaatatatataatatatattatacataggtatataaagtataactatatgtcatatagataggtatataaaatgtacctatatggcctgtaggtatataaaatatgccatataggtatataaaatatacttacgccattaaatatatatttaatatacaaatatatttgtttttttctatactgtaacaacatatgtctgtacattattattattattattattatttttgagacagagtttcactcttgttgcccaggctagaatgcaatggcgtgatctcggctcactgcaacctccgcctcccgggttcaagaagcaattttcctgcgtcagcctcctgagtagctgggattacaggcatgtgccaccgtgcccggctaattttgtatttttagtagagacggggtttctccatgttggtcaggctgctctcgaactcctgacctcaggtgatccaccgcctcggcctcccaaagcactgggattacaggcgtgagccaccgtgcccatcctacatttttttaaaaacacaaaattctggccagacatggtggctcacgcctgtaatcccagtgctttttttttttttttgagatggagtctcgctccgtcgcccaggctggagtgcagtggcgcgatctcggctcactgcaagctccgcctgccgggttcacgccattctcctgcctcagcctccggagcagctgggactacaggcgcccgccaccaggcccagctaattttttttgtatttttagtagagatggggtttcaccatgttagccaggatggtctcgatctcctgacctcgtgatccgcccgccttggcctcccaaagtgctgggattacaggcgtgtgccaccacgcctggcctaatcccagtgcttttggaggcctaggcaggagggtcacttgagcccaggagttagagaccggcctgggcaatatagtgagacccccatctcaaagcagaacaacagcagaacttctgagctagacagacaactttgctttgaatctgacaccagctttgggaaatacgctgtgcgcactgggccttggttgaccaaccttacaaattgagcagatttaatcagatggggtcaggaagtgctaattcagcacagtaaaaactcagcagatggaagctgcccactggggtctggggaatcttggggctgtggaagttagccagccttcgacattatgcactttgtacacatctgctcagaccgaaagaaggtccattttaaggctgggtgtgtactaagtaggtggaggaggaggaattatctgtgcctctttttcttttctttttttttttttttttttgagatggagtctcgctctgtcgcccaggctggagtgcagtggcgcaatctcggctcactgcaacctctgcctcccgggttcacgccattctcctgcctcagcctcccgagtagctgggactacaggcgcccgtcaccacgcccggctaatttttttttttttttgtatttttttttagtagagatggggtttcaccatgttagccaggatggtctcgatctcctgacctcatgatccgcccgcctcggcctgtcagagtgctgggattacaggcgtgatccaccgtgcccggccacctctggaagcagccagggccacacagtgcactagaatattcctcgctgatggcagaatattctgtgctgtccaacttggtcaccaccagccacgtgtggctctttggtgcttgaaatgtgatttgttcaactgagcaacttaaaatttaattttcttttctttttttttttttttttgagacatagtctcgctctgtcacccaagctggagtgcggtgactccatcataactcactgcaacctccacctcccaggcttaagcagtcctcccacctcagctccccgagtagctggaactacaggcatgccactacacccagctaacttttgtattttttgtagagacggggtctcgccatggtgcccagtctggtctggaactcctgggctcaagtgatcctcctgccttggctttccaaagtaccgagattacaggcatgtgccaccacgccccgcctaattttatttcagcgtagctaacttaaatgtaaaaagtcatatgtggctgtgacccttgtactgatggctgtagaacgtgaggagttttcaggagccaaatgatggaagaatggtcagcaggtggttgagaactattcccaggttttagagatgatttaaaatgagacggctggccgggcgtggtggctcacacctgtaatcccagcactttgggaggccgaggcaggaggatcacttgacgtcaggaattcaagaccggcctggctaacatggcaaaatcctgtctctactaaaaatgcaaaaattagccaggtgtggtggcaggagcctgtagtcccagctactcaggaggctgaggcagaagatttggttgaaaccaagagacggaagttgcagtgagccgagattgtgccactgcactccagcctgggcaacacggcaagattccatctaaataaataaatacataaatacataagatgaggcagccaaataaaaaggaaggagattctgaccaggctactcacatgggtgaaccttaaggacattaagctcaattgagaaaagccggacacagaaggacaaatactgcaagtccactcctaggaggtccctagagtcgtcagattcatagagacagaaagtaggttggcggggtcagggggtgtcggaggctggggaggggacggggagtgagtgtttcatggggacagagtttcagtttgggaagagtagaaagttctggagaggatggtggcgatggctgcatggccattggaatgtatttaatgtccctaaagctgtgcatggaaagttggttcaaatggtaaatattatgcatattttaccacaataagaaattaaattaaaaattaaaatgagatggcatagatttatagcatattatttttaaaactaaactaattttggccaggcatggtggtgctcacccatggttccaattactcgacagtctgaggtggggggattgctggagcccaggaggtccaggctgcagtgagccatgattgtgccactgcactgcagcctgggtgacagagcaagaccctgtctcaaaaacaaaattaggccgagcacagtggctcacacctgtaatcccagcactttgggaggctgaggcacgcggatcacttgaggtcagaagtttgagaccagcctggccaacttggtgaaaccccatctctactaaaaatacaaaaattagctgggctaattaaaattagattagaaaattagattacaggtggcacacacctgtaatctcagctacttaggaggctcaggcaggagaatcacttgaacccgggaggcagaggctgcagtgagctgagatcgcaccattgcactccagcctgggcgacacagcgatactctgttccaaaaaaaaaaaaaaatttaatttaattaaaaaacacataaattcctaggactataggaaaagaagaaaacttccttaacccaagaaagggaactacaaaaccccacagctaaccccgtacttagtggtgagaggctggatgttttctcccgagatcaggaacaagacaaggacaccactttccccatttctattgaacattgtactggaagttctgccagaccaataaggcaagaaaagaggctggacgtggtagctcacacctgtaatcccagcactttgagagaccaaagagagtggatcgcttgagcccaggagttccagaccagctagggcagcatcgcgaaaacccgtatctacaaataatacaaaaattagccagatgtggtggcgtgtacctggggccccagctacttgggaagctcagataggaggatggcttgagctcaggagttcaagactgcagtgagccgtgattgtgccaccttactccagcctaggtgacagagcaagatcctgtctcaaaaacgaagaagagaaagagatcagcctggctatcatggtgaaaccctatctctactaaaaatacaacaaaaattagctgggcgtgtgggcgtggtggcacgtgcctgtaatcccagctacttgggaggctgggaattgcttgagcccgggaggcggagattgcaatgagctggatcgtgccaccgcactccagtcctggcaacaagagaacaagagcgagattccatctcaaaaaaataaataaataaataaataaataaataaaagatacaaaataacaccatcaaagacagtaccaatagcgatattaatcaaatagcaatagtagtgaagctgccctctgcctggtgaagcactcactatggcagccatggttctgggagttttattaataattcattcatcacctttttttttttgagatggagtcactctgtcgcccagactagagtgcaattggcccgatctgggctcactgcaaaatccgcctcccgagttcaagagattctcctgcctcagcctcccaagtagctgggattacaggtgcccaccaccacgcccagctaatttttgtatttttagtggagacggggtttcaccatgtggggcagaatggtcttgaactcctgaccttaggtgatccacccacgttggcctcccatagtgctgggaatacaggcgtgagccaccgcgcccagccaatgtttcattcattaccatcttgtccctcataaacagcttccaagagggggtgctatagttgtgtccatttcacagatgagaagagtgaggcgcggatgcatccgaggccccgctccctggctgcccgattcgcaagctcatgctgggagccaccgtggggcctgacacttagtaggtgcccaagaaacattctcccttcccagggaaacacccggatgccagctgggcactgcggcctgctgagacgccagctgggcactgcagcctgctgagtctgtgtgggctctggttccggaagagggtcctgtgcccacggcctggcgcccggacggccggctgcccaggctgggtccttcccaacgtcatggccaccggtgcccagccttgagacagtccaaagggaactggccagctccgaggggccgctggcagccccagcctgggatcggctgcagggcttggggccgagctgggcacactcccctcggctgctgtccagcccagatggccacggccggggcagcctagctggaggaagggcttctctcgtctgctcctctgtttcctgacgaggaaactgaggcaccgggccctgctcctgtgctgttcatggcatccttggtcttggcaatcagtgggtgctggacacacggtgtgtgcatagccattagcacggcgccaggctaactccagaggctccgtgcgctaggaaatatcattgctttgatcattctcacagcaaccctgagaatggtctccatttatttttttaaaacaaggtcttgctctgtcactcaggctggagtgcagtggcatgatcacagctcactgcacccttgacctcccaggctcaagtgatcctcctgagtagctgggactacaggtgcctgctaccatgcctggctaatttttttttcttttttgttgagatggagttttgctcttgttgcccaggctggagtgcaataatggcgcgatcttggctcaccgcaacctccgcctccggggttcgagcgattctcctgcctcagcctcccgagtagctgggattacaggcatgcaccaccatgcccggctaattttgtatttttggtagagatggggtttcaccatgttgatcaggctggtctcaaactcctgagctcaaagtgatctgcccgcctcggcctcccaaagtgctgggattacaggagtgagccactgcacctggactgtttttttgtattttttgtaaaaacggggtctcactatgttgccctggctggtctcgaactcctggcctcaagcgatcctcccgcttcggcctcccaaagtgctgagattacaggcgtgagccactgtgccactgcccctggcttaatcatcatctcattttgcggatgaagaaactcaggccttgaaaggaaagtgaggccgggcgcggtggctcacgcctgtaatcccagcactttgggaggccgaggcgggcggatcaccaggtcaggagatcgagaccatcctggctaacacggtgaaaccccgtctctattaaaaattcaaaaaattagccgggcgtggtggcgggtgcctgtagtcccagctactcaggagactgaggcaggagaatggcgtgaacccaggagacggagcttgcagtgagccgagatcatgccactgcactccagcctgggcgacagagcgagactctgtctcaaaaaaaaaaggaaagtgaccttctcaggagcacaaagacccggggggtcttggagacagtacttggctcaggtgtctgatcccagcacaaaactgtagataaaataaccctggtgaaaaagcccatcacagggcctgggagggagaacattgctcgtggttctgacccgcagctttccttgtttatgaaatggatacagccaggcatggtggctcacgcttggcatcccagcactttgggaggccgaggcgggcggatcacctgaggtcaggagttcgagaccagcctgaccaacatggtgaaactcccgtctctactaaaaatacaaaaattagccaggcgtgatgacgcgcgcctgtaatctcagctactctggaggctgaagcgggagaatcacttgaacccgagaggtggaggttacagcaagccgcgatcgcaccactgcattccagcctgggagacagagtgagaccctgtctcaaaaaaataaaaataaataaataaaatagaagaaagtaataatggggcggactctcgtgattgaggtctccaaatgccctcaagtgcttcaggagtatcctctcctcactgcctcccagctctgctaaggcctgggcagtgtttgtgcccacgtggaagatgagaaacaggctcaggacagttaggcgacttgcctgaggtcacacagcgatcgcgtcctggccttggggtctggcgggtgggcaggaggggcgtgattctcttcctgcggctttcgacgttggttgctgccaccttcgtctttgacctgggtgatccatgggtggggctggggaggggcgtctgcctggctgggcttgtccacctgccccccaacttcagccctccgtggaggggtcagggctccagagggggcggatgtgactcgtcctgcatccaggctgccagagccgataacgctgagctcagcgtctgtctgcctgcgcgtctgccaaggaacctaattatttttagataagatggaggggcgggcgccggggcagagggagcacccaagctgggcgggcagtggggtcgtcgccatcagagagaccacccctcagcctcctctctctggggtccctgaacggcaacccaggactaacagccgggtccctgggactacaggggcagaggctgaggctaagggacgtgacgtctccaggactcacctctctggtcctcagtttccccatctgtaaaacggacatagtgatagacctcctgcatagggctaaggcggggctgaatgactgaacctcattttattttatttattttgttttatttattttattttatttattttgagacggagccttgctcttgtcgcccagactggagtgcagaggcatgatctccacttgctgcaacctctgcctcccgggttcaagcgattctcctgactcagcctcctgagtagctgggattccaggagcgtgccaccatgcccggctaatttttatatttttagtagagacggggttttgccatgttagccaggctggtcttcaactcctgacctcaagtgattttcctgccttggcctcccaaagtgctgggattacaggtgtgagccaccgtgcctggccgttttgttttatttttttgttgttgcttaatttcattttctgagatggggacttgctatgttgctcaggctggcctccaactccagtcgcccagactggactgcagtggtgcaatcctggctcactgcaacctccgcctccgaggctaaagcgattctcctgtctcagtctcccaagtagctgggattacaggtacgcatcaccacacctggctagtttttgtacttttagtagagatggggtttcaccatgttggccagtctggtctcaaactcctgaccctgacctcaggtgatctgcctcccttggcctcccaaagtgctaggattacaggcgtgagccaccgtgcccggcctgaacttcattttacagatgaggctcagagaaggcaagcgacttgctcagggtcgcacagcaagaaagcggcacagctgggatttgaacatcagtctgttaagattccaggtgtctaagttcttacccacgactgagccgcccctgcagaagcggagggcttacccaacatacgggtacactggcgctcacagggcctagctggtgtctgcagggtgcctggccagatgtctgtgaccctctagggcagcagccaagggaagggcccaaagagagaccccagggcctgggtgtgttttggggccactgtttgtctccatagcactggcccagcccaggactggggccaccagcatcgacacttcatctgctcctggggtggggtctctgtgatgccaccagtgtttcttccctctctttgcagatgcagagcaaagcggcagtccccggacagggatgggctctgaccaggaggacagcaagcccatcacgctgggtgagtctgggggcagcgtggcggtgaagggcggagggcgcagccctgtcctcgtcttttatttgggaatcatttgcttggcaccactcgttttacagatgagcagactgaggctcggagaggttaaggggcctgtccaggggctaccagggagctgggttggaacccacgactctgagctcccagcttctgggctctgaggtgctcaccccatgggagaccccagagggttctacggtcccatgggacgtttgagggtttttgtttgttttgttttgttttcattcatttatttattttgagatggagtctcgctctgtcatccaggctggagtgcagtggcacaatctcagctcactgcaagctccgcttcccgggttcaagtgattctcctgcctcagtctcccaagtagctgggattacaggtacctgccaccacacccggctaatttttgtatttttagtagagacggggtttcaccatgttggccaggtcggtcttgaactcctgacctcaggtgatccgcctacctcggcctcccaaagtgctgggattacaggcatgagccaccgtgcccggcctgtttgtttgtcttagaaacggtctcacgctgctgcccaggctggagtgcagtgacaccatcctagctcactgcagcctggaccagctaggctcaagcgatcctcctgccttagcctctcaagtagctgggactacaggtgtgcaccaccatgcctggcttttttttttttttttttttttttttttttttttgagatggagtatcactctgtcgcccaggctagagtgcagtggcgcgatctcggctcactgcatcctccatctcctgggttcaagcaactctcctgcctcagcctcctgagtagctgggattacaggtgtgtgccaccacggctggctaatttttgtatttttagtagagatggggtttcaccatgttggccaggctggtctcaaactcctgacctcgtgatccacccacctcggcctcccgaagtactgggattacaggcatgagccaccgcgcctggcttttttttttaattttttaaatatttttgtagagacagagtctcactatgttgctcagactggtctcaaactcctgagctcaagtgatcctcctgtcttggcttcccaaagcgctgggatcataggtgtgagccaccacacccagccctcatggggcgtctaatagatgggtaggacagtgtaattctatgttgtagggataggaagtgggaaaattaacctcacttagaccagagcagtcacttccatcctagcccccagctcctgcccttggcccccaccatttgtccttctcactatggccagaggacacctgtgagcccccaagtcagggcccgtccctcctctgcgcacagccatccacggctcccacctctcttggggtaaaagcccaggtcctccctgtggcccacaaggccctgcacaacctgtcccatccctgccctgtcctcccctcctccctctctccccgtcgtccactcccagccacacagacctcctcgccgttcctccagtgcaccagacccagtcctgcctcagggccgctgcacattctgttacctctgtctaaacagccaactaactgctcgcttgttctctccagatctcccctggtctcagctcaaatgcccccttctcagagaggtctaccctaaaccccttcagcataagcagcctctggctaccctcaatctttttttttttttttttttgagacagagtcaggctctgtcgcccaggctagagtgcaatggcgcaatctcggctcactgccatccccgcctcctaggttcacgccattctcctgcctcagcctcccgagtagctgggactacaggcgcccaccaccacacccgggtaattttttgtacttttagtagagatggggtttcaccgtggtagccaggatggtctcgatctcctgaccctgtgatgcacccgcctcggcctcccaaagtgctgggattacaggcatgagccaccgcgcccagcctggctaccctcagtctcagccctctgttttctttccttcagaggaagttagtgattgcctatggatttgcttagttgtttagtgactgcacgggtgtctgctcatctccccagtggaatgtcacctcctccagggcagaggctttgtctgtctacatctctgttgtgccctcagggcttagaatggggcctgatgcagagtgggtgctcaataaatacttgtagaaagaaaagaaggagagagggagggatgaagcagagagaagaagacaagagaggatatatggggagaggaaggaggagagatgaaaaagaaggaaggggccaagtgcggtggctcacgcctgtaatcccagcactttgggaggccaaggcaggtggatcacctgaggtcaggagttcgagaccagcctgaccaacatggtgaaaccgtctctactaaaaatacaaaaattagtcgggcatgttggcacacacctataatcccagctagtcgggaggctgaggcaggagaatcgcttgaacccaggaggcagaggttgtggtgagccgagattgtgcaccctgggcgacacagcgagactctgtcaaaaaaaaaaaaaaaaaagaagaagaagaaagaaggaaagaaagaaagaaaagaaagagagagagaaaaagaagggccgggtgcgggggcttacgcctgtaatcccagcactttgggggactgaggtgggtggatcacctgaggtcaggagtttgagactagcctgatcaacatggagaaaccctgtctctactgaatatacaaaaattagccaggcgtggaggcacatgcctgtaatcccagctacccgagaggctgaggcaggagaattgcttgaacccgggagacagaggttgcagtgagctgagatcgcgccattgcactctagcctgggcaacaagagtaaaaactccgtctcaaaaaaaaaaaaaagaaaagaaaagaaaaagaaggaaggggccagggcgcagtggcttacacctgtaatcccagtactttgggaggccgagtcaggtggatgacctgaggtcaggagttcaagaccagcctggccaacatggcgaaaccccatctgtactaggaggacacgggaggctgacgcaggagaattgcttgaacccaggaggaggcggaggttgcagtgagccgagatcacgccactgcactccagcctgggggatagagtgagactgtctcaaaaaaaaaaaaggaaaggaaaagaaggaaggaagagaaagcgagtgggtgaggcgtccttcttggaaggaccggaacaggcatgcacagggaggctggaaggttctcggaggttcacaggcctgaggccactcctcactggcccccggtgactcctccgtctgtgacccgggtcctccgcggcctcctgtgatccccagacgcctctctccaagccagatgttggagggaggtgggggcagcggcgcttggcctggtcccctggggagcttgggcgtctggtagaggaaatcacgtcctcccagctcgccagggagtcccccagagatggagctgagcaggcgctgcacaaacaggaaaccccggtcgggggaggcggagggggcgtgctgacaccagctggccagctgggtcagcaggaaacggctctggccacttctcctggacactcgggggccaccgctctgtcctcttcagaatgcgtggccctgaacctcccagcgcggggcagggttggttcattgccttcactcagcaaatgactgtaacagggggccgggtgcggtggctcacgcctgcaatcccagcactttgggaggctgaagcgggaggatcgcttgagcccaggagttcaagaccagcctgggtaatatagcaagaccctatctctacccaaaaaaaaaatatacacacacacacacacacacacacacacacacacacactagccccaggagttcaagaccagcctgggtaatatagcaagaccctatctctaccccaaaaaaaaaaaaaaaaatatatacacacacacacacacacacacacacacacacacacacacactagccaaacacggaggtgcatgcctgtaatcccagctacttgggaggctgaggtgggaggatcgcctgagcccaggagtttgagaccagcctgggtaacatagcaagaccctatctctacaaaaagtaataataataatacaaaaattagccaagggtggtgatgcgtgcctgtagtcccagctacttgggaggctgaggcaggagcatcacttcagcccaggagttcgaggctgcagtgagctatgattgcaccgctgcactcgagcctgggcaacagagcaaaattctgtctctaaaaaagaaagattgtaacagggggactggcgggggtttgggtctgcagaactggacacagccctgagctccctgcagtccgtgctgccccctgggggccgggagaggaactgctcccaccgccacccaaaagccaagagcctgtcccacctccaaacctaccaggctccctggctctttccactccaaccctgctggcctgcaacttgccaagtgcatttctacccggaggcctttgcacgggctgttcccagtgccgggaacatcgtggccctcagggaggtgatgaaacatcatccccatcggagaagccaacagtcacggggcggttgccaggcgctgttctcggagctttgcagattttaacaagttccttcctcttatccagtctcatcttgaggtctgtaaaatgccaccatctcggtcaggctttctctgagccctgggtgtaaaatagcctccctccccaccctagctagttccccaccagccgcctgccttaccacaggctgatgcacctcgcatttgacttaatgagcttttaatttgtagtaaaatgtgcatgatgtacaatgcatcattttagccatttttaagtgtccaagtcaaagtgcactaagtacattcacctctatctaattccagaacctttctttttttttttttttacccccaggctggagtgcagtggcgcaatctcggctcactgcaacctccaccttcctggttcaagcaattctcatggctcagcctcccaagtagctgggatcataggcacatgccaccacacccggctaattttttgtattttcagtagagatggagtttcaccatgttggccaggctggtctcgaactcttgaccttaagtgattctcttgcctcagccttccaaagtgctgggattacagatgtgagccgccgagcctggcctaattccagaacatttcatcccccctaaaagaaaccccatccccatcagccaccactccctgtctcctctcccagccctggtgcccacgcatccccttcttgtctctgtggcttggcctgtcctggacatttcagtgaaatggctcatgcctgtaatcccagcactttgggaggccaaggtgggtggatcatgtggtcaggagttcgagaccagccggaccaagatggtgaaaccccgtctctattaaaaatccaaaatttagacaggcactgtggcaggtacttgtaatcccagctacttgggaggctgagacaggagaatcgcttgaacctgggaggcataggttgcagtgagccaagattgcgccactgcactccagcctgggcgacagagtgagactccgtctcaaaaaaaaaaaaaaagaaaagaaaaagaaagaaagaaatggcatcacacactgtgtggccttttgtctctggtgtccctcactgaatgatgtcctcaaggtgcatccatgttgtagcctgtgtcagagcctcgttcttttatttttatttatttactggttttgagatgaagtctcactctgatgcccaggctggagtgcaatgtcgcgatctcggcctgtagctgggactacaggtgcccgccaccatgcccggctaatttttgtatttttagtagagatggggtttcaccatgttggccaggctggtcttgaacccctgagctcaggtgatccacctgcctcagcctcccaaagtgctgggattacaggtgtgagctaccactactgcgcccagcccaaggcctcattctttttcttttccttcttcttttttttttttttttttttttttttgagacagggtcttgctctgtccccgaggctggagtgcagtggtgcaatcatagctcactgcagcctcaacctccagggctcgagctatcctcccgcctcggcctcccaagtagctgggactacaggtgtgcaccaccacgcccagctaatttttgtactttttgtagggatggggtttcgccatgttgcccagtcccgtctcaaactctggggctcaagtgatccacctgcctcagcttcccaaagtgctgggactataggcacaagccaccatacccagctaattttcgtattttttgtagacacagggtttcgccatgttgcccgggctgatctcaaactcctgagctcacgagatccacccacctcagcttcccaaagtgccgggattacaggcatgagccaccacgcccggcatccttttcacggctgagtcctattccagtgtgtggctagaccacgctgtgtttatctcttcatcttttgaagggacatttgggtggctttccagtttgagctgtggtgaacagtgctgctaggaacattcgtggacttttgctgacctattaatcttggctgctgtctgtcgctcacactggactttgagtctcacaggggcaactgcttcagcctgtatcatctcctgctgtgccggggcccagctcagaatcagacactgtggatgcttagtaaacgcctgttgagtccatgaatccctcctacaagggcgtccgagggcaggacagggctgtccccaagctgtctgaggttggccaaggctcccgacctctcggggacaacttcgatttccaaatctgtgaaatgggtccaaaccactccagtcgagaggacagtctcccttcctttaatattaggtaggagcaatgctggggacactgagggttttaactgcggcttgtgggcctcccattcaaccccccattttaactgacccattgctgggtgccaagctctggtctaggcacgaaggacactgcagggtcggggcagacagacatccctgcccacacggacctcccagtctgaaggggagaagaacaagaagccagagtatctcgaagggtgacagtgtgtaaagcaagccagctgcccctcccaggcagttggatacagatctcacgacaaccccgatgatgggattgatggtttcacttttgcaattagggaaacttggaggctgagagagggaaagtgacctgccccagatcacacaccgaggcaggtgatggagccgatgtgagcccaggcctccgctttccgctcttttttttttttttttttgagatggagtcttgctctgttgcccaggctggatggagtgcagtggcgcaatctcggctcactgcaagctccacctctcgggttcacaccattctcctgcctcagcctcccaggtagctgggactacaggcgcctgccaccacgcccggctaatttttgtatttttaggagacagggtttcactgtgttagccaggatggtctccatctcctgacctgtgatcctcccgcctcggcctcccaaagtgctgggattacagacgtgagccaccgcacccggctccactcgttttttaagagagggtgtcgccctgtttcccaggctggagtgcagtggcacaacaatggttcattgcggcctccacctcccaggctcaagtgatcctccagcctcagcctcctgagtagctgggactacaggcacggaccacaacacctggctaattttaacactttttgtagagatggggtctcgctgtgttccccaggctggtcttgaagtcctgagctcaagcgttcctcctgcctcggcctcccacagtgctgggattacaggcatgagccactgcgcccggcctgctgttcacttgaatgcagcattccacagcatgggggaacccggatgaaggctgtgtgaaggcccacactggacaaggaccccccacggggccttccccatcagactggagctgtcattcccccacagcacaggatggacagggggaacgtccaggctcgggccagcccccaggagtccaggcagccctggagtgtggggaagggaaacaggcccagctcagcctactgaccccgctgtcttcctgttccagacacgaccgacttccaggagagctttgtcacctccggcgtgttcagcgtcactgagctcatccaagtgtcccggagtgagtgttcccgtcagccctgagctgggtcttggagaggggagggggccgcagggaggaaggagcccacccccctcaccctactccttgtcctttccagacaaccccctgtgtcactaagccaaggttcctagaaagggaggtggccaggcccttcccagagcccaaggtcagggctccctcccacctctccaggaaacagaatctaaatgctggatggcaactaaggaaacttctgccccagcatccctcctcctccctggggcctccactgtcctgtcccaggagaccccaaaggaccccgcccctcctgtccccttgctttctctgctgacctgctggggacccagcacattccgtcacacactgtctgaatcccaccccagcgagtcctgggcgctgtccttctttagccctgactgacaccttccctgtccagatcagcagagcctggcctccagctttggctacacctctgcctcacagtgtgctcttggcctctccccatggccttggtcctctgatccatagaataaaactggtttcagccaccctaggaaccgggccaatatgggaagggggtccccctttggactgcacccagtggctttccctacctctctaaagcaaaccgcagcactgggcactgcttcctgcctcactctcctctgtcaccctctgcagcacccgtggtgactggaacaggacccaacttctccctgggggagctgcaggggcacctggcatacgacctgaacccagccagcactggcctcagaagaacgctgcccagcacctcctccagtgggtaagtacccaggtccccacctctgggcatttcatgaccccattcatcaacccatcccctctggcccgagctgactcattcctctccctggaatacctcttttcacgattcacctggcctgagaaactcctactcatctcatccttcaaaacccagccagccccacgtgcctcttcccctagccctgacagcccaccgtgggctcccccagcctcaagtcctgccggctcagccagcccttaggaccctccccacccagaagaatgcagacacaggttgttgctgagatatgctttgtgacctcgagcaggtcacactgtgtgtgccccagtttccccatccataaaatgggatcatacccctaacaggcagttctgaggactacaggtggccaggagattagccaggctgcctgggttttggtctccaccatgctagcttggtgtccgacctgtgttgagaccctccctgcctctggcccgggtgtcccatccaagcaatggacaggttggaacaggcgttcgtagggaacgggctgaacgcccgcggctcccgcgatgtctcgcgatactacctccctcgcccccgctcacttaaggaccggaagtagcaaagcccgccgtcgcgccccccgccccgcgtctccctggtaaccagcctctccccttccctcgcccataaggagcaagcggcacaaatcgggctcgatggaggaagacgtggacacgagccctggcggcgattactacacttcgcccagctcgcccacgagtagcagccgcaactggacggaggacatggaaggaggtagggctggtggcgggggcggagccggccttccggtctgagtcaccgtggcgggaactacgtcttccggcagccactgcgcgggcgccgcggggcaggaagccggcctggagccgcggggcctcctgggaattgtagtcgtcccgagctgcgcttggctggaagtacggtccgggttcgcgttctcggatctctttggttccgctgcggcgaaggagggcagagactgtcccctgcctgactctcctgccctccggccgtgaatgccacatctctgtggggtccccgagctgcaggatggactcagtagtgactctgatcaacagggcgcctcttcctgggatctgtcatagaatccctcgtctgtagggaccctgtttgtcctcttcccctctagaaggtcctgagatgccggatcccttctcattggggtccttcttgaggttacttttttttttaaccaggttcccatctccatgggatcttctggttctgcaggagactcgtctcctttctgtagggtctccattcccatggcgtcgttttctaggaagattttatcctcttgcttttctgtcttcagaagggtcctctctggggtgtctttctttctttctttctttctttcttttttttgagatggagtttcgctcttgttgcccaggctggagtgcaatggcgcgatctccgctcactgcagcctccacctccctggttcaagcaattgtcctacctcagcctcccaagtaactgggattacaggcatgcaccaccatgcccggctaattttttctatttttagtacagacggggtttcaccatgttggtcaggctggtctcaaactcccgacctcaggtgattcgcccgcctcggcctcccaaagttctgggattacaggcgtgagccaccacgcccggcctctgtttttgtttgtttgtttgtttgtttgtttttgaaacggagtctcggtctgctgcccaggctggagtgccggggtgcaatcttggctcactgcagcctcgacctcccaggttcaagtgatcctcctgcctcagcctcccaagtatcggactgcaggtgcatactgccatgcgccgttaattttttttttttttttttttttttttttggtagagatggggtctcactatgttgcctaagctggtcttgaactcctgagttcaagtgtgatctttcctcctgcctcgtcctcccaaagtgctgggattccaggtgtgagccaccatgccgggcccctcttatttttttttaatttttgttttttgagatggagtcttgctctgtcacccaggctggagtgcagtggcgagatcttggctcactgcaacccttcctcctgagttcaagcaattctcctgcctcagcctcccaagtagctgggattacaggcacccaccaccacacccggctaatctttatatttttagtagagacagtgtttcaccatgttggccagtctggtctcaaactcctgacctcaggtgatccacccacctcggcctcccaaagtgctgggatgacaggtgtgagccactgctcccggccacctgtaggatttttagaagcagtataacattaggattaagaggtcagattcaggcattggagagacctgggttcagatcccagccctgcccgtgtctagctctgtgtgctgtgtaacctggggcacatcacttaacttctctaagcctcagtttcttcatctccacaatgggggtgatgtgaataatgttctttgggagctacaggaggaggaagggtaggatgtgcgtgaagcaaccgtctggcccatgcgacatacccgggaaacgggaggtcactgtcatccacgtctttataacattcctgtctctgaccaggctcggtggctcacgcctgtaatcccagcactttgggaggccgaggcaggcggatcacgaggtcaggagatcgagaccatcccggctaacacagtgaaaccccgtctctactaaaaatacaaaaaaaatagccgggcgtggcggcgggtgcctgtagtcccagctactcaggaggctgaggcaggagaatggcatgaacccgggaggcggagcttgcagtgagctgagatggcgccactgcactccagcctgggtgacagagcgagactccgtctcaaaaaaaaaaaaaaattcctgtctctttccggcactcggacgcatctagttgtgacatttcaggtgccaaggcccctcccttccacagtgtgggctcccagagcaggaacattcctaaagggtctccatccctcaggggacctgtctcagtatttatgaggttctttttttgtttgtttgttgtttttgttttgagatggagtcttgcttgttttgagagatcacgccagtgcacgccagcctgggcaacagaacgagactatgtctcaaaaaaaaaaaaagaaaaaaaaagtcacttctgtttcgttttttttgttttttgttttttgttttttttttgagacggagtttcgctcttatcacccaggctggagtgcagtggtgcaatctcggctccacctcctgggttcaagtgattctcctgcctcagcctcccgagtagctgggactacaggcgggcaccaccacaaccagctaatttttgtatttttagtagagacggtttttactatgttggccaggctggtcttgaactcctgacctcaagtgatccgccaacctcaagtgatccgcccatctcagcctcccaaagtgctggcattacaggtgtgagccaccgcacccagccgtgacttctcattaactctgtaattgatgaggctgtcagaatgtaaactgcacgctaattaaagtgaaagaccacctttgcgatgagccaaagcaaccctgagaggaaaaattgtagctttaagtctatttattaggagaggagaaaggtggaaaataaagaatctagctttcaacagagaaaactcaaaaagaaaacattttaagctctggagctcagtctgacttttctgcccggctgctcactggcaaccccttccactggggaaggaggtggtagcaatggggggaggacaaagaggaagcccccaccagcttctgctctgtgattgggaatcgcagagctagcagggaatgtcagaggaggtctgtgctcctgcagcttccacttgattacctcaggggatggcaaactcactccctcctgagggtttcttttttttttttttttttttctttttgagacagagtctcgctctgtcgcccaggctggagtgcagtggcgccatctcagctcactgcaagctccgcttcccgggttcacgccattctcctgcctcagcctcccgagtagctgggactacaggcacccactaccacgcccggctaattttttctattttcagtagagacggggtttcaccgtgttagccaggatggtctcgatctcctgacctcgtgatccgcccatctcggcctcccaaagtgctgggattacaggcgtgagccaccgcacccggcctcctcctgagggtttcatcctcagtgtaaagccctcctgtgtgctggccctacctgaggccctggggacacagagatgatccaacccactcttgtccctaccttccaggggctaacagcctagtgagggagatgggtttttatccaggtgactacagcccagaggaggaggcacagaagacagtcagggggaacaagaggaccctgatagaacttggaagaaaagggaggacctccccgaggaggagaatcaggctgacagagcagtgaggagctcgggcaactggcttctctgcttctccagctgtgtgacatttggcaggttccttaacctctctgcccctcaatttcctctgctatacgatcaggttgctggccgggtgcagtggcttacaactgtaatcctagcaatatggcaagaccccatctctacttaaaaaaaaaaaaaaaatagcatcacatagtggtgtacacctgtagtcccagctccttgggaggctgaggtgagaggattgcttaagacgggaggtcaaagctgccctgagctatgatcataccactgcactccatccggggcaacagagaaagaccctgtctcaaaaaaaaaaaaaaaaaaaaaaaaaaaaaaaaaaaaaaaaaaggctcacctgtaatcccagcactttgggaggccgaggcaggcggatcacctgaggtcaggagttcgagaccagcctggccaacagggtgaaaccccatcattactaaaaacacaaaattagccgggtgtggtggtgggcacctgtaatcccagctactcgggaggctgaggcaggagaatcacttgaacctgggaggcggagggtgcagtgagccgagattgtgccattacactccagcctgggcaacaagagcgaaactccatctcaaaaaactctgccttgatatcccagtgaagagaaaacactggaagaatttttttttttttttttttgtcagagtcttgctctgtcgcccaggctggagtgcagtggtgtgatctcggctcactgcaagctccgcctcccgggttcatgccattctcctgcctcagcctcccgaatagctgggactacaggcacccaccaccatgcccggctaattttttgtatttttagtagagacggggtttcaccgtgttagccaggatggtctcgatctcctgacttcgtgatctgcccgcctcggcctcccaaagtgctgggattacaggcgtgagccaccgcgcccggccaaacactggaagaattttaacacccgtggcccagggctggactttacgtaaagcacgcacctggggcgtgagagccgggtttattattaattcgcggctaagctacaaccgggatgatttaagtggatttatccgcagggaagatgatgggagggcattcccagcagggagaatcgtggtttgaggagttgcactgtggatgtttggggccagaccatcctctggggcggggctgtcttgggcactgttgggtgctgtgcagagttcatggcctccacccactccgtgtcaggagcaccccccagtggtgacaaccgtaaatgtccccagacctggccaaatgtctcttgcgggcagaatctcccctataatatagccagaggcatatgcaaagcacctaaacggagtggggagaaggtgcgtgacccctggtctgggccactcttttttttttttttgagacggaatctctctctgtcgctcgcccaggctggggtgcaatgcgcgatcttgactcactgcaagctctgcctcccaggttcaagcgattctcgtgcctcagcctcccgaatagctaggattacaggtgcccgccaccacggctggctaatttttgtatttttagcggaggcgggttttcaccatgttggccagtctggtctggaactcctgacctcaggagttccaccacacccggctaattttgtgtttttagtaatgatggggtttcaccctgttggccaggctgctctcgaactcctgacctcaggtgatccgcccgcctcggcctcccaaagtgctgggattacaggcgtgagccactgcgcctggccttttttgttttgttttgttttgtttttcccaaatagtgacttgctctgtcgcccaggatggagtgcagtggtgcgatcagcgcccactgggctcatgccatcctccttcctcagcctcccaagtagctgggactatgggcacttgccaacacacctggctattttttgtactttttgtagagacagagttccctgtgttgcccaggctggtcttaaactcctgggctcatcctcctgcctctgcttcccacagtgttgggatggcaggtgtgagccaccacacccggctggccgctttttctctatgtcccttcccaacattttagtcccagacagccctgcggaggtgcctggcaggcacctcattttgcagagggaaaccctgaggctcaaagaggtgacatcacctgctccaggtcaccccagcggcaagcgggtgcacagggacacggaaccacgtggccgttcccagcggccccactcagggtacctcgctctctttgttttatggggcatctgtgatgtcctaagccgggttatttcccctcccggcaacactctgtgagatcagggctgcccctggccatcagttgacaagtggggaaactgaggcccaaaggtcccacagcaaagaaggggcagagccccgagcttatgcccagtgcttcctgggcctctccccatcgctgtggcctgcatcggtaaacatttcgcagcctctgaagtcccaagggggacgcctcagaacaggcctggcccctgggctggagcagggttcctgaggttcccagtggggcccagctgtaacctcattggtggaccgaggcaagggccagaggggcccaagggaagggccagaggggccgggggcacaggaagggccggaggggctgggggcacggggagggccaggcttattgttgcagcctgcaaggctgtcccaagccgggtgcctccgcagagggaggacacaaaacaggaacccaggcaggcagggtctctcccgaaggtgcccttggcccctggccaccaccctgggatgctcctcctcctcctcggcatcctccccccacccttccctgccctttccagcttcctgtctagacagcccccaattagccactcattaagggggttaagctgattagagcagctctcccttcctctggcggactcggggccttttctcccgggcagtgctcagccagtccccaaccctgaggctcacagaggcctggggggatcatgccagcccgatgccaggcaagacccccaccccacacctccaggccccacattccagcctctaggctttgcccgcttggggcctgggccaggccctttctcctggccgcctccacccgaggcctccctgcttacgcggctgcgtggggtggagggaaggtgccttggagcagcccccactgtgctttgtttttgctgcttgtgtagctcccccttgaaggcgacaaaggtcccgtccacaggcggttattacacagggcggggcaggcagcccccatccattcctctcctctgtcaccccaggcttcccatcccttttttttttttttttttgagtcagaatctcactctgttgcccaggctggagtgcagtggcatgatctcggctcactgcagcctctgccttccagattcaagcaattcttctgcttcagcctcgcaaatagctgggactgggactacaggcgcctgccaccatgaccagctaatttgtgtatttttagtagagatggagtttcaccatgttggccaggctggtctcaaactcctgacctcaagtgatccgcccgcctcggcctcccacagtgctaggatgacaggtgtgagccaccgagcccagcccgcccatccctttttttaaccccagggtggaggctagtgcaacgtggcctggggagggacagagttgggttccaactccacctccacccccccttggctctatggccttaggcgagtgacgtcccccatcaggcctcagcctccacatctgtgaaatgggcgcagctcctgtaagctctgcacggggcagctgtgaggaccacattaagagaggaggctagtgccttcacagaaggtcctcacccagggcgatgctgccccacccccagggacactggccggtgtctagggacatctgtggttgtcacaactgggagagctcttgacatggagtgggtcgaggccagggatgctgcttagcaccctgcagtgcccaggacagcccctccccagggaacgagccagccccaatgtctacagtgctgaggctgagaaacctgtattaattatgtagaaaaaaattgaggctgagtgtggtggctcacacctgtaatcccagcactttgggaggccaaggctggaggatcgcttgagcctagtagtttgataacatagggaaaccctgtctctacaaaaaaataccaaattagctgcatgtggtggcgtgtgcctgtagtcccagctactcgagaggctgaggttgggaggatcgcttgagcccaggaggtcaaggctgcagtaagctatgattgcaccagtgcactccagtctgggcaacagcgtgagaccctatctcaaaaaaaaaaaaagaaaaagaaaaaagtctgccccctgctcacaacggaataaactcctagtgtggcagacggtgtgtaaaccagggggacccccagctcctgggactcacctcctctctccctccccactcaaggtgtggatttcaatgtgtgcagcctcctgggacctctgcagggcagaggatcatgggacgcagaggatcatgggacgcagagtctcttgggggtccatggaatcctctaagacagaggattttacctatgggtgatcctgaccccagaggacactgggtgacatctggggacctgtgtggttgtcacgactgcagggtggtcctggcatggattgggtccagggacaccgcttagcaccctgcagtgctcaggatggccccaccctagagaatgatccggtcccaaatgtccacagggcccagaggagaccttggtgcactgtcaacgccccgtggtcactgctgtcctcatcagattcatgccctgcatcggggcctctgtccactccacacactctgtgtagggcccctcctgaccccggaccctagagacccagccagagtgggccttggccccctgggggagccggcatttcagtgggagatgggcttgtttgttgagcaaacaaatggctgctccgacggggtgatgagggccttttgtcaaatacaaagaggaggtcagatgggcgtgtgtgacaaatggctgctccgacggggtgatgagggccttttgtcaaatagaggaggtcagatgggcgtgtgtgacaaatggctgctccgtcggggtgatgagggccttttgtcaaatacagagaggaggtcagatgggcgtgtgtgttaaacagacaggaagaagctctgatgggggagccctcgggcctgcgtcctcctcacagtcaatattctcagatggggcattcaggatgccgggagtggcgtatggatgtgttccctgagaggaaagatggccactgagatgggcgggggacgcacatgcccgctggctgaacagggaggtcccacaggggtcccaggcatgcctgctgaacagacagaggatgcttggaggcggggtgcagagtcagtgtccgtagagcctgccgggagcgtgccggcttattctttctcgcggtgcctgagctgcgctcccccctccttcctgccctgccctggctgccgctggccccatctcaggaagctctagcggtgcctgcagggatgtggcggccgggggtggagtctgagccagactatttccatccaggacaagcggttctaggaaatcctcctaaatgagcgtctgacaaccctaacctcgttcccgccgtggccctgcgcttgcagggagctgccagcccctgcacacacacacacacgcttgcacacacgcatgcatgctcatacatatatgcacgcacgtgcacaggcgtgcacacatgtatgcatgcatgcttgcagacctgtacgtgtgcgtgcaagcacacatacatagacatgaacatgcatgtgcaggcatacacatacatgcatatattcacgtgcacacgcatgtgcgcattcacacacatagacacgtgcacaggcatacacatacacagatatgaacgtgcatgtacaggcatacatatgcaggcgtgcacacgtccacatatgctcacatgcgtacacacacatgcacagacatgcacacatgcatgcagctgtgcacatgcgtgcaggcatacacacatacatgcacgcacacacatgcatgtattcacatgcacacacacacgtgcacaggcatacacatgcacacacacgtgccgacaagaccagcctggcctccccggctccaggccaccctcattcctgccacatcctcctgccctggaaaagcccgggcctggctgctggggcccagcttggtcacagacttcatggcatcccactgggcagtggggcctctctgggtggctcagcctcgatgtccgaggcctcaggagtgttcccccttgagtgttcacaggctgggcatgagtggaggtgtcatccttcctgccccccatgtgggtgtcctgggtgcccgcctcctccagagccgggtgttcccgggtccctgggaactgctgacctgcttctggggtgtgtcccagtgacaccttcactcctcacagcatggtgtgtgcagggccatggggacagctggttccataaccacaaaagcagatgaagagctgcatgtccccccacagctgggtcctggatctgggctccccctgggctgcagccatcagagaggacggaagttccctgagtggtaaccccgttcagggaaggatgcagcgatgctgggaggatggaggaggtggggacaggactggggagggcctgtaccacacagatgcctgcaggtgcctatggaaccaccagcaggagacccaagacacggtgacatcctcaccgtttctcatcagggcatcacccggggacagcaggtcacatctggggacatccgtggttgtccccactgaggggcgctcttggcacggagtgggtggaggccaggggtgctgctcagcgccctgcagtgcccaggacagctccctacagagaccgatctggcccccacatcagcagtgctgagactgagaaatcctgcgtgaattatttggaaaatattgagttacgtcactgctcacaccagacaccagaagaagctcctgacagggcagacggtagaaaccagggggaccccagctcctgggattcacctcctctctccctcctcactccgtgtggatttcagtgtgtgcagcctcctgggaccacagcagggcagaggatcatgggacatagtctcgtggagggtccatgggatcccctaacccagagggtctcacccacacgtgattcttgcccagggtacttttggtgatgtctggggacatctgtggttgttacaaccgggggtgctcctggcatgaagtgggtggtggccagggactctgctcagcaccctgcagtgcccaggagggccccaccccagagaatgatccagccccagtgtccacagtgcctgtctgagagaccctggaggtaaggaactccaagggccaggtcgaagggaagctaaactcatcaccctgtttggatggtctcagtagatatgttttaccttaaaagaaatgtaaaaatcctttctaaaaattcggctccccagggcacgcctccctgagattccatttccagggatagggtagggcccaggacactgcatttctcaggcaagatgtgatccttagccctcacttgaaaaagcttctctggggccaggcactgtggctcacgcctgtaatcccagcactttgagagaccaaggcaagaggatcccttgagcccaggagtttgagaccagcctgggcaacatagcaagaccccatctctaaaaaaaaaattgcctggacatgatggtgcatgcctgtggtcccacctacctgggaggctgaggtgggaggatcacttaagcccaggaggttgaggctgcagtgagccatgatcgtgcctctgcactctagcctgggtgacaaataactcggctgggtgcagtggctcacgcctataatcccagcactttgggaggccgaggtgggtggatcacctgaggccaggagtttgagaccagcctggccaacatggtgaaaccccatctctactaaaaatacaaaaatgacccgggcgtggtggtgggcgcctgtaatcccagctactcgggaggctgaggcagtagaatcgcttgaacctgggaggcggaggttgcagcgagccgagatcacgccattgcactccagccagggcgacagagggagactctatctcaaaaaaaaaaaaaaaaaaaagacacagccccagaaggccaggcatttcggctccagagctgggactccaccccagcctcctggaaatacccaaaatggccctctttggggctctgtgttcccacttcattttgaagacagggtgaaagtgtcaaggggcaccgtgtcatctccccactcaccccaaatagcagcagcagcggctcctgcagtagctaacattcttccagctgggtggctgacgttccctcggaaagcagggctgaaggcatcctcagagaatgccccgatgcccagggatctgggacggccatgggcttcacctgcacaggcacccctggcccaatcctcacagctgccactcccacactgctcccgatggaaattccagagctttacagaatcccctgttttatgaaaaggggtagacgtggcagctcaccccaggtcgcacagcctcatggccagccggggtttgaaccctggaccacctgcttcccccacacccaggggctttccagggggtgcctggagggggagggaagccgatgtttggtgggtgagcctccctgagtccatccgttttttgtttgtttgtttacttgcttgtttgtttttgagacagtttcacagtttcattcttgttgcctgggctggagtgcaatggcgtgatctcggcccactgcaacctctgccgcctgggttcaagcgattctcctgcctcagcctcccaagtagctgggattacaggcgtgagcccctgcacccgactatccatctgttttttgtgtttgtgatggagtcttgctctgtagccctggctggagtgtagtggcgtgatctcagctcactgcaacctctgcctcctgggttcaagcgattctcctgcctcagcctcccaagtagctgggattacaggcacccgccaccacacccacctaatttttgtatttttagtggagacagggtttcaccatgttggccaggctggtcttgaactcctggcctcaagtgatctgcccacctcagcctcccaaagcactgggattacaggcatgagccactgtgcctggcctctgtttcttcattcattgattcactgaggaaggtgtgaggggctgagctgctgagttgggggctgtgggggcttttgtcccaggcagcctgggaggtagtgaggcccctgtctgcagagtgatgccagcaagtcactgcagaggggggatgcacctcatttcagccccagggaggctccgttccttcctcccgcgtggacgagggaaggcagagctgagctggggcttgtctgtgcgcccttagccagtcagggtctaactggacttcggatctgactgtctctgccctccctgccaccttctctagggctcgggtgactcccaggtgatggggcagccctgagccttcccatttctctggaaggagagtaggcaagggccaggagcgaggcccaggggcacgtgttgatacccagctctccatcccccggctgtgccgccctggctagccccttctctgctctgagccttcgtttactcctctgtgtaatgggctcacagcctctccccctcaggattctggggtaagaggaggcggggtgatgaggcttcctatcccttcggaggctggctttggggaaggtccagggctcatggggtgtgaccagcctgtgactctctcgtcccatcccctccacaggcatctcgtccccggtgaagaagacagagatggacaagtcaccattcaacagcccgtccccccaggactctccccgcctctccagcttcacccagcaccaccggcccgtcatcgccgtgcacagcggtaagcgccacgggcccctggcggggaggggcggcgggccctcctatcaggcctctcacagccggggaagtcccactggatgtctgaccatgagtcctattgctgtagccttctaggtgggcaaaaaaccatagaggtgccgtagtggagagcgcccagggccttgttccagcccggctgagaggttggactcagtccctttgggcctcagtttcccccctgtataacaaaaggctgcaacctaacttcacctcactcccctcacccccgtctcaatctaatccccccattccaaccccagacactgatggacaggcaggatcagaagctgccaatgaggccaggcacagtggctcacacctgtaatcccggcactttgggaggctgaggcgggtggatcatctgaggtcaggagtttgagaccagcctggccaacatggtgaaaccccatctctactaaaaatacaaaaattagccaggcgtggtggcacgcacctgtagtcccagctactggggaggctgaggcaggagaattgcttgaacccgggaggtagaagttgcagtgagcagagatcacaccactgcactccagcctgggcaacagagtaagattccatctcaaaaaaaaaaaaaaaagctaggcttggtggctcatgcctgtaattctagcactttgagaggccgaggcaggcagatcacaaggtcaggagttcaagaccagcctggccaacatggtgaaaccccttgtctactaaaaatacaaaaattagccgagtgtggtggtatgcgcctgtagtcccagctacttgggaggctgaggcaggagaatcgcttgaacccaggaggcagaggttgcggtgaggcgagttcacgccattgcactccaacctgggcgacagagcaagaccctgtctccaaaaaaaggctaagtgcaagtggctcacgcctgtaatcccagcactttgggatttcaaggcgggcggattacgaggtcaggagattgagaccatcctggctaacatggtgaaaccccgtctctactaaaaatacaaaaaattatccgggcgtggtggcaggcgcctgtagtcccagctacttgggaggctgaggcaggagaatggcgtgaacccgggaggcggagcttgcagtgagccaagatcgtgccagtgcactccagcctgggtgacagagcgagactccatctcaaaaaaaaaaaaagagacatctccatctcggccaggcacagtggttcacacctgtaatcccagcactttgggaggccgaggcaggcggatcacctgaggtcaggagttcaagaccagcctggacaacatggtgaaatctcgtttctactaaaatacaaaaattagctcggtgtggtgatgcatgcctgtgatcccagctactcaggaggctgaggcacaagaatttcttgaacccgggaggcggaggctgcagtgagccaagattgtgccattgcactccagcctgggcaacagagcaagactccatctcaaaaaaaaacaaaacagaacaaacaaaaaatcaccttccatggttgccattgggattaaggggggtgaattgtaggaagcctcaaatattgcttaccaccccatgttctagtgatcaactatttagttctttacacagtcatgcacacagagaggcagtcccaaatcaaagcagccatttgggccaggggtcagcaaacgctggccccctggttgcctgttcttacgaataaagttttattggcaaacagccacgaccacgtctttgtatatgtcctgtggcagctctcaccctgtcttggcagggctgagtaattacagcagagaccacgtggccaaaagccaaaaatatttactatctggccagaggctgtggagatgagggagtgactgctataaatagtgaaaatactaaaaatcactgaactgtttagaaagaggaaaaggcaggcaccacaatagaatatgactcagccatgaaaacgcacgaggctctgacgcaggccaccttgaggacgtcatgctcagtaagagaagccagacaaaaaggccacacagcatgtgatctcatttctatgaaatgtccaggacagggccagccacagaggcaggaaggggatgtatgggtgctggggctgggggaggaggtgaggagtgacggctgatggagacggaatttctttatgtgctggaattaggccgggcacagtggctcatgcctgcaatcccagcactttgggaggctgaggtgggtggattgcttgagtccaggagtttgagaccagcttgggcaacatgatgaaaccccatctctactaaaaatacaaaaaattaaccaggcgtggtggcacacgccggcagtccgtgctactcaggccgaggcaggaggatcacctgaggtcaggaggtcaaggctgtagtgagccatgatcatgcccctgcactccagcctgggtgacaaagcgagattctatctcttaaaaaaaaaaaaaaaagatcactattcagccatttgcagaaagagcttgccaaccctagatttatagtgtagactgtggggccagatgggctgggttcaaattcccggtctgccatctgatgccgtgtggccccaggcaggtgacacatcccctgaaggccaccctgtcatcctctgtttaaaaaaaaaaaaaaaaagacggggccaggtgcagtggctcacgcctgcaatcccagctctttgggaggccaaagtgggcggatcacctgaggtcaggagttcaagaccagcctggccaacatggcgaaaccccatctctactaaaaatacaaaagttagccaggcatggcggcgtgcacttgtaatcccagctactcgggaggctgaggcagaattgcttgaacccaggaggtggaggttgcagtgagctgaggtcataccactgcactccagcctgggtgactgtctcaaaaaaaaaaaaaaaaaaaaaagaccaggctcagtgggttacacctgtaatccccgcactttgggaggcctaggagggaggatcgcttgagcccaggagttcgagacctgcctgggcaacatagcaagacccccacctctacaaaactaaaaaattaaattaaaacacaaggataatatcacagccccagtggggttgccgtgggagtcggggaatttgggtgtcaatgtggtcagtgctgctgggtttttttggtggttattgttactaaacgcactgagatgccggcaggaatgacacccacagacacacagtcacacggtcacagagcagaccggctggagcccccaagtaacccccgcttcccactgtctccgcagggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccggtgagttgggcggggcgcattcgggcctctcctggcggctccaggtgacctcccgggggccacgtgctcacacgaaggcacaacctctgcttaaaagggtcttgaggacttggctctgaagtcccctcctctgtcgtgctgggaggcagctggattgggtcagaattgagatgctttcggatgtcagggtttcgggcgcatcatgtcgcaccctgtggggtctgggtagcacccgtaggtcccagcaactgcgtgagtcgtactcatgttaacacaaggcagggagggactgggcatagcggctcatgcctgtgatcccagcgctttcggaggccaaggcgggaggattgcataagcccagagttcaagaccaacctgggcagcatagcgtgacccagtttctacaaaaaaaatacttaaaaatgagccacgcatggtggcgggcgcctgtagtcccagctactcaggaggctgaggtgggaggatcgcttgaacctgggaggtcgaggctgctgtgagctgtgattgtgccactgcaccccagcctgggtgacagaacgagaccctgtctcaaaaagaaaaaaaaggttggggggcggggggcaggaagacattgattacaaaaaaaccaccaaactcagttcgagcaagacagcgtttgccagactccacaggaagctttggatgttcagagcttttcggactttggaaccacgggccaggccgtggatgatggtggatgatggcgtgctcgcagtgaattaggaaaaacgcggagaacctgctgttaggaggcggtggcactgtttggaaggaaatcagtcgagttggcgtgcagggggtttacagaggagatgcagtgagcgtggccccagtagtgccgggctttgagtgacaccagcaagcgggtgtccccaggcccctccacctccggccgtcctcagacccaccaaacccgccatggtcacacccgcgccctggccccccagcctgccaccccgtccgggccgtgcacagagccgggggcggccggcgccagcagcccgaggtagagggggagcccaccccttaaccacgtgtctctctgttcccccagttaaatggaagtggtcagctcaaaatgcccagccactgcctttctgctcagatgctggcacctccgcccccggggctgccacggctggcgctcccccctgccaccaaacccgccaccacctccgagggaggagccacgtcgccgacctcgccttgtaagcacgcgggaagcggtgccctggtggggcggatgtccgcaggggggcctgtcccctccccagccccactgccaggtcagaggtcaggcccgaccctgcagggcctggcgagtttggtgggtctccggaaaacagcccagtggccacgtggttgggcccatgtagggctgaggcagccttaggggctggccggaccaagcctcgggccagggtgagagtccagggtctgtccccttcgccgagtcacctgggggaccccggtgcccgccgtgggccgtcagaaaccctccctggtatgtcaggcagctgacagtggacacggatctcacagtggcggcccgagggccagactcgacccccagactggtcttttgtttgtggagaaagagaatcggttgttatcattttaaaatcaggacgttttacataaacatttccagagttctggcttcttggggagaaaggagctacaccaggcccagttcctttgggtgacctgggctggaccacacctttagatgggactctcttcgcctgtccacctgacctggaagcccctgggttggcggctgctgcaccttctagatttttctgctctctggatgtggttctgggtggctgctggatggcccctcggtcctggcatccctgtcctgaggtccaccccattcgtccgcagtggctctacccccagactctccccacgacccccatgcaggcttgggtgggtcacccaccctcacagggcgccagacatctctgaacccagagacctctccccatggactccatctgcccctcacccccctttttgagcatctctgtccctcactctccaaatgagaccccccaccccacccaagcagttggtggccacggttccttctaggtgccctcagctcctcttctccctgccccggcgttcctgtccccgtccccactgcgtgccagaacccaggctgcctgcccataaaaaccggcttctgatcactggctggaggagatcagccccaaatccaccctgggctggaatcccacctctgcagctctctcactgtgtgacctcaggcaggtgtcttcccctctctgagcctcagttttctcagctgcaaagtgggtttgccttggtgcccaattcacagggcagtgggggacaagccggtgacatgggtcagggaggcagagaggacattccatgtggcgcctgatgctgcgtggtgtcaggcagctgtggtcattcttgccggctgtccctgcctgctcatctgtgaaatgggagcgttgactgcataggatccagtcagggctcagtgggatcatgcccagagcctggtattcagtagacacttaataaatgcaggatactgcgtgggatccactcagggctcgatgggattatgcccagagcctggcatacagtagacacttaatagatgcaggatactgtgtaggatccactcagggctcggtgggattatgcccagtgcctggcatacagtagacacttaatagatgcaggatactgcgtaggatccactcagggctcggtgggattatgcccagagcctggcatacagtagacacttaataggtgcaggatactgtgtaggatccactcagggctcagtgggattatgcccagagcctggtatacaatagacacttaatagatgcaggatactgcttaggatccactcagggctcgatgagattatgcccagagcctggtttacagtagacacttaatagatgcaggatgctgcttaggatccactcagggctcggtgggattatgcccagagcctggtatacagtagacacttaatagatgcaggatgctgcttagtatccactcagggctcaacgggattatgcccagtgcctggcatacagtacacacttaataaatgcaggataggcatggattccacccccctttccctgcaccggggctcttaactgcaaatctactcctacttctccccataagcctcgctgcctccagctccccccaaccccagccaggacaacttggggaccctgcctgttgcagcttcttctccccctacctgggtcccggcctgtctgaggcccccatccctgctgtagccccaggccgtgagttactcacacgccgacaaaatataatcgctgaggctgaaatataaatacgcacatctgtatgtatgcacacacccagccctccctctgccctctccgggaggaagattaataaataaaacgccctcaataattcatgcaccccgcgcggaggcagccctcagtggcaggaccgggcgggcgctgcccaccctgaataattcacgggcggttttgtgaattacagagccatcctgccttccctctcagcagacaccccgcccacctgggcgatctcagccgtgacccccgggcccctcgagtcaggatccccgcctcccaaggaccttgggcctttcaggggggcccggttcaactgggggtagggcggcaggctcggaggccccaggcactgggtgcagaggcccggctgtgtgacgcctggcggtggccaccctctctggggccagggccgccccggctcccacaacccctcgctaacgggctctcggtctctctcctccctgcagcctactctccgcccgacacgtcccctgcaaaccgttcctttgtgggattaggaccaagggatcctgcgggcatttatcaggcacaggtaggggccgagaggccggctggtggggtgggaggggcagggcagaggggccggcccggggggctcagggcgaagagggcctgctgggtcccacgccacacccctggcacaggggcgccagcctcccacaccccacctgggcctcgagcccccacctggcctctccctgaggccaaatttccctccaccttggtcctggggggatggggtgtggccccagactcagcctgtggggtccccaggagcgtctctggagaccatcgtggtacagctatgggaccagtgtcattaccacctgcttcccatggtatagatgggaaaactgaggcccagagagacaagggggtctgcccagggtcacacagtgcatcaccctccctcctccagcctccatcccccatccacgccgaggcctagagggaccgcggggtggccgggggaaactgaggcagcccatggcggggcgtggggcctcccaggacagcatccaagcccccaccccaggcttcagcccacatctaagccagtgtgaggagtcagggcggagaggcttcgtcagcaggacagacaggatggggcaggggccagcgttcatgttcacgttgatgttcatagtcacgtacatgttcagacggctgcagctgagtgagcatggccggggtcccaccacccctagaaggcaggcaggcaggcaggaggttgacagaggaggctcagagaggggaagtcaattgcctgaggctgcacagtagtctagggagtgggggcgtgggagggcagccttagccccaggcccaggtgtccctcaccccccacccccataaggggctctgtgtaggccaggagtgtgtgagcgcgtcttcgggttatgggtaagcagctggacctttgagcctctgctctctccccggtttgtgttggggagagggttggaggatgtaggagtggctgccacaggcccgggaggtccagactcagagagaaacgagctctgggctacccagcggccacggaactgcagagcgtggagatgtatggggtccccaggggccgtgttcaaatcttccagccactgagggaggtttcctgctgcagagcccacgggcaagggtcacggggcctccccgggaccctgcggggctgtcctggctgagcggatgggggcggggaggggacatggcattccccctccctccctgtgctgggtgcccaggatgcctgtaagcggcccctccctctcttcccaggctccgcaaaaccagccggaggaggaagcagggatggaggctgcttctcctgagttcagaggagatccatgtgctatgggtggagggaatcctgggtcaggggccagggctccagcccagtgctggctcacccactctgaacctctgtctcttcctctggccttgggcacccgcaccaagagcctttgaagggcactgggggacagaaagggcactgaaaggttcaggcttccccacaccccgtaaatattaagtaccctgccttgcacccatagagccccggagagggagtaacttggtcagggtcccccagcgagcagacgtccaggactcctcgctttgggatttgggccccctatggccaacctctcccccgcctggtgctgatggagcccggcattacctctgccacccccaccccacatcgctccctgcccctgcgggaggctgggaacgtcttaagtggttcagaaaccaaagctaataaaagctgcggtgggaggaggcccagcccgcttaacccttccccagcctctgccttggaccaaactctctgaccaggccctcccgccagggcccgggacccttctctcagactgtgctggctccagccccaccccacccaagcctgggagggaagggaaactgaggcaggcaagggtggcacctttctcagcatccctatcttgactggctggactcctctggggacccagaaagggtgggaccagggctggcagaatggggtgtgggggggcactggcaaggggctcagcataggcaatggtgtgggtcgggggagggggagctggctggaatgtgagagatctccggtggcaggggccagacagatgatgcgggctttgctctggggtagtggggagccatagaagggtttagagggagggagtggacacccaccaggcctgggagtcagaactttctggagcacagaaaggaggtgacacattgtcaagaggctctcaggggagcatgggttagggggaaggcgaggtccccaaactgggcatccagggagcacaggtctggggaggaccccattgctgctgccctgactggactaagagcacctgggttgaggccgggcgccgccacctccctgcagaccccggagagagggagggaagaagcagtgagatcccgctctcccctctcccagctcccgctcaaagggccctgagcttggaggcctctcatttccgattctggccagtcagcacttctgcctccgcctcctctattcctggcggattcgcttccctctgccccctcctcccccaaagcctgggtgggcgcgcctttccctctgcctctccggctcccgacaccccccagtccatggactctccccccatcaatatccctccccgtgatctatgctaattgatctcgccctggtcagttacccacccatcgccccatgtccgtccctatcaatccccccactgtgaggctgggtggctctgacgccctggcccctcccctctgtgatgtccttcacgcccctacatttctcctgcacgggaacccacgtaagcagctgggtaaaccgagggtggggggcaaggcgggcattgagccacatgccgggagccacacaggcggctgcagccaggccagcaggataccagagcccaaacctcccccttcacacctactgcctcagtctcccctcagctgagtgggaggatgtggagttgagggtgcccccaccccacccccgccccattgctggggccacagccaggcaggaaggggaggggagggaagggaggagggaggaagggctgaggggaggctggtccaccacggggagggtcacgcccagagtctgtcggttgccaacagaaaccagacatgaggtaatggccaagatgaacttgaacttggctggaggtggggcgctgggaaccactgtggcgccagttccatgggctggcccagtggctgcctggttggaggggctctgttgaatgatttgctgcagcggtggggggcggccccacctctaacctcagttggggagtggaggggtctccccagttccagaggcacagccctcccctcacagtccaccctggatgctccatctggggttggagtttgcgtttccagggcaggggtctggacagcagcttctctgcagagactgaggccggagctgtccccaaatgacgtgaccttgggtacagccccatgcagaactcccctcccttagcctcggtctcccgcctctgggaggttgagagtcatcctcagcccccctgtgcttagtgagcttctgtggagcaagagggggccatccgggggacctgtgacaggatgggccctggacgcccaggacagtgctcagaagatgccaaggggattcctgagaggcaggcgagggggttggccctgggcaggagcagaaatgagagccagagccagacaggcctgagttcaagttccacctctgccgcttccatgctggtgacctcgggcaagttccttgacttctctgggcctcactttcttcacacaaaacagcggtggagggagacctaccccctccttcacggggataccggggacatcattaaagaggagaatttttttttgtttttttttggtttttttggtttttgttttgagacggagtcttatgctgcccaggctggagtgcaatggcacgatcttggctgactacaacctccgccccctggattcagacgattctgctgcctcagcctcccgagtagctgggattacaggcacgtgccaccacgcctggctaatttttgtatttttagtagagacagggtttcaccatgttggccaggctggtctcgaacccctgacctcaggtgatccacccaccttggtctcccaaagtactgggattacaggcatgagccaccgagcccagcctcttgtttactttttaaaaacattctcaaggccatgtgcagtggctcatgcctataatcccagcactttgggaggccaaagcaaacgaataagctgaggtcaggagtttgagaccagcctggccaacatggagaaaccccgtttctaccaaaaatacaaaaattagctgggtgtgatggcgcatgcgtgtaatcctagctactcgggaggctgaggcaagaaaatcacttgaacccgggaggcagaggttgcagtgagccaagatcgtgccactgcactccagcctggtgacaagagcgtgacgctgtctcaaaaaatcaacaaaaaacctctttataaagtgaacaaggcagctgatgtggtggctcatgtctgtaatcctagcactttgggaggaaggagttcaaggccagcctggtctacatggcgaaaccccacctctacaaaaaaaaaaaaaaaactagtcagatgtggtggaacatacctgtggtcccagctactcgggaggctgaggtgggaggatcacttgagcccaggagatggaggctgcagtgagctatgatggcaccactgcactccagcctgggcaacggagcaagaccctgtctcaaaataaaataataaattggctggccacagtggctcacgcctgtaatcccagcactttgggaggccaaggtgggcggatcacttgaggccaggaattcaagaccagcccggccaacatggcgaaacccggtctctactaagaatacaaaaattagctgggtgtggtggggcgggcctgtaatcccagctacttgggaggctaaggcacaaggatcacttgaacccaggaagcggaggttgtagagagccaagatcacaccactgcattccagcctgggcaacagagcaagactctgtctcataaataaataataaatagagaagaaaataatttttaaaatataaaataaaggccaggcagagtggctcacgcctgtaatcccagcactttgggaggccgaggcgggcggatcacgaggtcaagagagtgagaccatcctggccaacatggtgaaaccctgtctctactaaaaatataaaaattagctgagtgtggtggcatgcgcctgtaatcccagctactcgggaggctgaggcaggagaatcacttgaacctgggaggcagaggttgcaatgagccgagatcatgccactgcactccagcctggcaacagagcgagactctgtctcaataaataaataaataatataatataataaagtaagattgagttccagactgggagtgctggctcacacctgtaattccagcactttgggaggccgaggaaggtggatcacttgaggtcaggcgtttgagaccagcctggccaacatggtgaaaccccatctctactaaaaatacaaaaattatccaggtgtggcggtggacgcctgtaatcccagctactcgggaggctgaggtaggagaattgcttgaacccaggaggcagaggttgtagtgagccaatatcacgccattgcactccagcctgggcaacaagagcgaaactccatctcaaaaaataaaataataaataaaatataaaatacagttccagataaatggatcttttgtgtgtggtgtgtaagtatatccccaatgttgcgtgggctagacttatactaaaagaattctgtgttaaccagaactccagtttcactgggcatcctgtactgtgtctggaagcctccctcagagacaaagtcacttgccatgggtcacccagcaggttgttagagcctgggatggggaaactgaggtcacagggttgcaggaggtggggggtgagcgtgggaagaggtaaaccatgtctgcagcagagtctgacccctcgacttctctccctttttctctctccctctttctgtcgccactgggccactcagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagagcgagtggtttaagtgcctgattaccaccacccgcccccccctttgtccagctgggacacggaatggccgcgggcctcctccccctcccctccagcctctccaccagcccctccagtcaaccctcatcgccgtgcccccccagagctagagagatggggcccctgcgtggcccgaggggcagagctgggcgtcacttcgcaagcgtcctgccctgccggggcgcgggggtgggctctggggaagccggtgcgccccccacgcctccgctgccagtgccttacattctggagcgacccccctccctggtgcctcccagcgaagggggaccgccgtttgcactttcatcgcctaccccgacgcggggcccagctgcgggacgtgcatcacggctgggcccccagaggagagaggaggccgacgccagcggtccccgctcggaacggggagggttttcggggggttcggcgtcgcaccttggggccccccgcagccgtgtagggggcctcccatctgctaagcgtttttccgttgagccgctccaaaaacactaagctggggacgccaggtgcccccccaccccggctccctggccctatccacacctccacccccaccccaggatcgccatctttaggggaggcctgggagggggtgttaggtgttttagggccaccgagctcaaacacaaggacccctccccggcccacccagcccagccccaactgacctccatgcctagggaaaaactccccccaccactgccccctcccccgacccaggccaaagccagggcaggtctccgggtctcacctgctcctagcctcacccccctgcccccgaaaaccagactctcctcccaaactagcctcaggagcttggcgaacccgctcgctcctaaagagaaagacccaggaccctcccccatcacccccaagagaggttcgccatcctctggcctcgagcccttggtccctccgtccgtctgtcctcggggcccgctcccccggtggcccttggggatcaaagcgtgggccgctctccgggagggcgggcgggggagggggtggtcgggttgtgccattggggtgtccggaagcttctcagccagggtgggggtcgtggagtgggggagggaggccagccgggctccagaggggtcagggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatctaaaaaaaaaaaaaaaaaaaaaaaaggaagaaaaaccacgctaaaaatcaagccactgaaaacaattgcccccaggtctacccagcccctggctgtccttggtcctgtctcccctcctgctgtattcaggggtgccccctggtgctcagcctctaccacccccaaccctgctcttgggtacccagaggggtcatttctgaatcccttgcccagaggacagacctccggggcccatcttggccctgggaaagggctctcctctctgattggtccctaggccacgggccggcccccagacaccattcaccgacccactgcaggctgtcctccaaccatggggtggccactccacccgcagccagactccccgctccccacttttcatgcaggctggcatacccctggctcagggtcaaatgctgttccacacccacctcagaggcaccccctctcccctgccccgtgcatccccacccttcttgccaaaggacctcttttcccctatccagagaccaccccaggtggcattctctcccaccttctcctttgtcccccatcccctgtctctgtcttccagctgtgaatatgaagggtatcctgtatgaaacaaaaacaaaacctgatatatgcaatatctgtctgtctgtctgtacccatgggcctggctcagccattggaggcccagccgagggtccggcagggcacagggacagccaggtggcaccgagtcacaggctgtggtccggtggctgagcatgctgttgtcttgtccttgattttattttcttttgttctttttttttttcttttctttttgtttttaactccagcttcctttgctttttacttgaccaaagctaagacaatagccagatggttagtggggcagccaggcagggaggacccagggctgggattctccaaccttaggccattcctgcagccctcaccacctccagcccctccaagcatctcgtgtagggacccacgcagatggtcccattcattcactattgcccccaaccccgggattttgggtggtctccacagccaccatcatacactcatcccgtgttttcttccaaaaagtcacctcagcagcctccccaggcgatacagagggagagcccagaccaccacagctggccacgacattgcccttaagtaatatgcattggccagagagcccgggctggctgtgcacagcattcatgtagctgatttctagctttttttttttttctgccccactcctgagcaaatctgtcttgccaaggaactaggagcaaccggaggcaaagggagtgggtggccccatcactattgggaccatcgcgtccctgcacagcccacacccgggggcccagagtcctgggctggacgccacccttctcaccccgagcttgcctccttggctcacttggcaccttggctgagtacagcaggcaaaagcccataccaggcagcatgttgtggatggtttagttctccccgcctccctgtttcttggaaaagctacagggtccctgtagggcaaaattcccaggcgccttgctgcagacagagtaagacaaaaacaccaggaagcaggattccgtgcccatctctgcagtttgggttcacaaaagggggtgccgtcatccctgggtggaggagggagtgttggttttttgtttttgtttttttaacatgtatgaaactgacatcttctcaaatcttgttccacccccctctggaagcccccatcacccacccctgctatggacaccacacctatgccaggcccccccccccaccccagtctcattctggggtctgcccatgctgtgggaaagaatagggaggcctcccaaatatatgcaaattgtccccattccgtgggggcacctgacaatgacccgggtggagatggggcatggaggagtaggaagacccagccctatttgactggggagaggaggatctggagtccttcatgcccaggtctggaacccaggttctgaccccagggccccaccctgggctggacaatcagatcccaaaggaatgccaaaggggactcggttgggagagccgcttaggggccagacctgggtccccctgcaggtccccaggcagcagacaattccaccttccctgccccaggaccttgagagacagcagcattccaggcacagacagacttggctgcaccccactgtcccttgcaagacaggttctggagccaggagcaactgtccagccctccagaagagacagcaagcagcccccctacccactctggcctccccaatggtactttgacctccagtgtagggctatactatacatatatatatatatatatatatatatatataattttggaatttgtttctcataatacagaatatatagtggctaccttgtatcttggtctggattctctctctgagaccccggattttactttctctttggagggcgctgggacatacatctctcaatccagcttcctccgcatcctcccatcttgccccatttctgccacgtcagacacttcctgagagtctcaccttcaaaatgacaccgctgcccatccattgctcaatggtacagagtgtggggtcagtccaccacccttgacctcccggcagggcaaggtgaggaggcggacccaaagcagtaccagcaggacttgttgccagtgataccaaaacagacttttcccaagcagtgcctcacatgtctgctggtgtggctttgggattctcctgccccacccccccgtccatggcagccccctccccaaggctttgctcacacctgagacaggaaggaggaaggggatccaataggaatatgggccccggaggggaagtcatgcacccccaagccaccaccccccagccttccacgcacatctcctggctggaagagagccctccaaaaaggggacacaggctgccccggcccctcaactgcatccacaccccatcctctcatcttgggtcccagccaggcccccccaaaaccaaagccccctcaagtcctggggtcccagcctgtgcccccagcttcctgcccacccagccctgagcattctcacacagagaaagaacaagcaagggctccagggggacaggatggggcagggcatacagtggggggtgggggggcagctgggaggagggagggacaaaacaaaacattttcctttgggttttttttttctttcttttttctcccctttactctttgggtggtgttgcttttcctttccttttccctttgagatttttttgttgttgtttcctttttgtattttactgatatcaccaggatagtttactctccttctagctttctgcttaccgcacactggataacacacacatacacacccacaaaaatgctcatgaacccaatccggagaaggttccagcaggtcccccaccctcccctcctcctcctacttctcctcttgacagcgaggacaggagggggacaaggggacacctgggcagacccgccggctctccccccaccccaccccgcccctcacatcatactccaatcataaccttgtatattatgcagtcattttggttttcgcggacgcgcctacctaagtaccatttacagaaagtgactctggctgtcattattttgtttatttgttccctatgcaaaaaaaaaatgaaaatgaaaaaagggggattccataaaagattcaataaaagacaaacaaaaaaaaaagaaaaaagaaaaaaatgtataaaaattaaacaagctatgcttcgactctt

SEQ ID NO: 2449 - DNA, 102652 bp, Homo sapiens; identical to SEQ ID NO: 2447

SEQ ID NO: 2450 - DNA, 109656 bp, Homo sapiens; identical to SEQ ID NO: 2448

SEQ ID NO: 2451 - DNA, 102652 bp, Homo sapiens; identical to SEQ ID NO: 2447

SEQ ID NO: 2452 - DNA, 419702 bp, Homo sapiens
ctgcataacactgacatttttattagaattcatttgtaacaaatggaacttgtgtcagcaaagaactgattttcatacagacttctttcgccaccaatgtaacgaagtaagaaaataaaaagcacgcctttcattctgtaaaacatttacgcgtactactaattagaggtaattgtattttttaacaagccattttacaagttatttgttttaatttttcagtctatgcatccaaaacgagagcaaagaacacaactgttattatctttgtaaagacactccaagctgggatggcaaagccacataacggatggatagaatggatctgtagccttctgatctctgctggagtatcagggcacccataaacccaaaaggaaccaaaacccaaaaagaaaaacaaaaagggaattaaaaataaaaggacttaaagcaaaaccgaaaataaacaggaaagaaaaaaaatacgtgcattactgcagacttttttcccttcctgtttctatgttgtgttatttacatacacacaaatgaatttccgaagcagtttcttacagatgggttcaagtaatatcattattgggtgtagaatcaatagggcagtgcatagtacaaaggtatagaaagtgcaaagttccctagaggcccttccctcccctggctgtcctcgccgttttctaaccatgcaaatcatttttaaaaaagagctaaaataaagttctgtacaaatcactttttatatattttgattttttttaccattgtaactaattacaaaattatacataactacacgtacataggtaaataatagcaccgtactggttatgatgatgaaaataactggaaacttgaaagcttgtggtaatggcagataaagatggttcacctgggaaattaaaacttgaatggttgtacagaaaagcacagagtggaatgcacatcaatgacagtaagggagttagttctaggaacagctcctgaacagtaagattcccgcaatagtctccgcctcgttcgtctatggtatgcatcccattcattttcttcttctgattattgtcatctttccctttgccaaatgggcagttattgtttcagggagagaagctgctcattggccaatcattctggtgtgcagtgctccatcggattctacatgtccaacaaggcatgtctggatgatgcaatgtctgtctgaccccctttgtttaactaaaagaaaattatagcactgagtaatctggcacttggataaatctccaaaaagatacaaactaaaagaaaataatgataacagacccacatagtgcacattcttctctggttctgatgtaggttagagagtctcattctgaggtagccttctagatacttttttttagtattatatatattttcttttttttctttttctttgttttttacaaaagtgctcaaatacaatgcttgcaaatgtttggtctcttggatttcactctgctagcaatgggaaaatgtggaaaacaaaaatccttccatgcagaacatccatgaagctaaaattaaaccaaagtagtatactcataccaaaactctttaagagttccttgggtattttgaggattatttaaaatcatgtaatatgtggcaaacttatgccatcatccatggcttcctatagaaattctgttggaagaattgggggtaagatacatatatatatatagtttatttccccttttagaaaaatcctaatggaatatcaaatatattccaaagttgccaatgatatttgttactaaaataagtttggtgcagttactgcatgttccagagcggatttggaagggaatataaataaaacaagtagctttttctgatgttgatgattgattataaaaggaagaagggccctgattatccaagtgctttgggctggtacaatcactaacatccccgacttggctgaaaactaggaatgcatattattcaaagagtttttgtacatgtggtaaacagataatgctttaatagaaagtaacagatacgaacagtgaatggaaatacgaaccaaaagctaaaaagaaatgctattaaaataggcatcaattataaggcactctaaatgcaaaactaaaaccaaaacgaaacaaagtacagcacttcccaggaatgctgtatgccacaaaatgtttctgactgaacagagtaacatgaatttggctttgcccctgttacatatcataaatgcaaatttcatagcacatactatagacaatatacgattgaatacactttttttaaacaactcgatagctgatatattacaacattctcccctcctaaagggatatgcactgacctttcccacatgcacacctcttagctatttaataataatttttattgcactagagtgttagaaatattgaactttgttggaagcctgactaacaaacaaacaaaacaatttgtggatgtgattgattggttaggtgggggtagattaggtaggaaatcagggggtgaggtttgacaatcaatcactgatgtgcattcctcatttccctttaaagaaataccaatatgtcaaaaaattaagaataaatggaaagagatgtttacaatagcttttctacgtttaaaaaaactaaatcatggaagaactgactgactgataactgtatctattttttgtgtggacacactgtctatatatacatagacacccttataaaatatggatatatatgtatatatgttagcagcaactttatactttgcgcctccctgttgattccaaaaacaaaacaaaataataattatctttgattatttgaagagaatgggtactttctcaccaatcaaaactgaagtgtaaaattaatatatctgacgagactgatactgtagattgagttttgcacaaaaatgtgcaaattttcaaatgatttgatatttctacagcaagatattacagataacagttctacagcttaaaaaaacctacgatttggaaataaaaaaatgaagagttatgtaacttttttaaaattcactttatcgaatgatacattttgttaaaaaaaagtttacacagttagaaatgaagcacaggtcagcagtatctttacaatactaaaaaactaaatcaaggactttctttttaaacattccctcccctttccccctaaaatgttattatgagcagtatggtgggaaggggcgatgtcaaagcagagtccgtttcattgtgagaagccacaccagcacatatcttgtgctgaactgcagcattctggcaatttctccttgcacctttcaagcaatcctgaataagatggtggttctttgctgtgatttcttcttcccttgattttgaatccttgaggtatctgtaaataaaatccttcagatgcctcatcagtcaggattctcttcattatttttcaggttagattattaaactgtgaattcttggtccacctggaataatttgtttttaatttgttttgtgtgtaatagtcccactaagtagttgttagctagaagttaagaaggacttctcaagtgccctgtatggctcagaagagactccatggatattgaagggcctgtagtaaaaatccagaatgggtcaggggtttctacgttgcatagtggtcaaagctgcccaggtactctagtgcggcacgataggaaaactgatattgatcctgcaggagacaatgaatggggagaagcaaaagaagggaccatgagcatattttaatagaaaaataaaaatcaatattgcataacaaaataacatctatataggggcaaaatcactactttcgtcaactggtctaatccaatgaccaattgtttatagtgaacaaagaaaaagccacatggggtgttgattaactttgccaatcaatttgactaaaacgatctcccaattccaagcagtggcaggtcgagtgaacattaccttcccagacaagtgttttccaagtagtatcaaaccattaccaccaattgaacacataaacttcttacatgccttataagcagataatgatgaaaatcatcctttacaattatctgcttattcaagataactaattctcagtttaaatatttaagagaggctgatacagacacaaactgtcctgagaaaaatctgaatttacttatcttctgaactactgccaacagaatttgaatttttaaaaaattatgtttggacagtagagcttgcagtgagaatcactcacagtcatttcagctaccctttggctgtctctctcacttacatatgatgttcatatacagccagaaggtagctggtgcggcacaccaggcacacaaatccatttacacagggcactggacttccaagctttccatccctgaaaatggcttcacaggactggctgcccacatcaaaaaatacctgtaaattcagcccaattctgtgtgattgctagttgtctgttttagagaggcacacactaaaaaaaagcagtatgaagcatggcctttttcagacaacgaagaacactatcatattggaataaattgaagcattgttggagagatggaaaaatcacaatttacagctctctatagggatgaggaaaaggattttccccataaaagaaacctattttcagtggccaatcgggctgaaagtagacagatagtttctattttgcttaaatgtgcatttttctgtaataaaaatggttggtaatgcaaaataaatggtgtttactttcctatcttgtcacagtaagttgcttggctgagtgttaaggctttttaaatgtccaatttccctctgtaacccctaagacccattaagtttgtcaagctggcataatgttttgactattgcaagccaaacacttgcactactttgaaatccgtctgaaagatactgtggatgatgaattgaggaacacatataagttgtataatttggtggccttttgcagaacataaactctatcagtaatattatctttagaaatgaatgctcaatagaccagactggctatatcataaactcttattattacgagaaatatccaaatttccatattaattattggaataggaaatgaggggctaatattaatatctctaggcttatccagaatcaaaatgttttgaatggccattgttaagacatgaaatatagaagagctgatacctctgtaggcatacagagggagaatggagaagttaaatgggctgagattatattatgtactaaatattatgctttctatatatttatatatttatattataggactatgaatataacgaattttatgaaattgccattttattggtcaaaaatggtccagtagtaaaatttaacatagctcaatctaacatataatctcacataatttctatagcaacactaagacactaataatctcatcccatttaaaaagggggaaaatgaggttcaaaattattaaacagtttgatgctttccccacagtattttgtgtctggtgttgagagagtatggagtccgggaggtccaggctagcaaaacgtaggctcttgagatgcgaaaaatgcaatggattttctcacctctgtctgtaccatagctggtcgttgtgttcttaacattttgacagtctggaagatatctacaactccttcatatctcattctttccaaaacaatgcttagcgttatgaagactccagttcttccaacgcccgcgctgccacaataacaaaggcgatgttactgggtgagatgttcacagtcttggccacatttgcttgggtgtggacatacttctaccagcttccacactccgtatctctttatagccatattcaggaaaacatggtatcacattcatcaaatgattactcttgggatactgagttgtaacagcatgtgataatgaggatgaagtaattaggagtaagtctaataaaaggtcttttcaatggggatttataccattttagaaagaccaaggaaacataacaaatgaaaagaaagggtaaataacatataggtttataatattcatggagattctgaaatttacaacctgcctacttaatatttttaaagtatgaaataattcagaataaggtgaagtgaatttggcatcttcaacttttctatcacactgttcacattttgcagttacttaaaatacatatgcgatgcccataacctaaatgtatttgcctataactagtcaaatgtttacactggttttattatgagaaaagagatggtataacagggtatatacgtgattttcacttagtcttcaggagggtttatgactatcctgtaagtgtacgtacacatgaagtaaatactatgttgttttcttatttcttgagacttagaactttcaacagattctcacaggggtctctaatcttaaaaaaaaatggttaagagccattgatctctgaacttagctaccatttttacatgatcagcaactaaaaccacattagaaaggttttgagtttctctctgttgtcttcattgttttaagataactccagaatcttcacggtagcaagaaagaaaattaattcatagctcttgtgcacttaaggaggaaagcaatgggaagttcagataatgagggaaacagtgaataatctgaaaaatccctgcatttttggatcctaattaaacagcatgtgtaacacttgggcacgggctgtagaaaatagatggattcatttactggagggtgtagctgacaggcatatataaatagtgtgtccctttataaatggggtttctacagtctaaacagaaatgttaagtgaggtttgaaaatccaagcggagtcagtctttaagaagtgattgaagatgtctagcggcagtgaaaccttctgttaagatgaagcagatgaccttgaaggtcccttttaaccttgaaagtctctcttagttgtgagaaactgagatttattatctttttgttgaatgatctaggtactccagagtctatcttaccttgccagagtctatcttaccttgatttgatagctcgaatgcaacaaaaacattgggttactttctactaagtattttcaaaaaaagaacagacattggactcacaacttttcaatttactggttttatcatcttactttaataagttataaataagaaaagtggtattttcagaacattcctaaataagaggaaatatatagaagtcttctttgtgtgtgtgtgtgtgtgtgtgtgtgtatatatatatatatatatatatatatatatatatatataaaaggtatatgcatcgcaattcctttagcattatactaaaggaatattaaaattattttatgacaaaaacaatgagaacaggcacacataacacatttatgtacctatacatataaggatgcctaaagttaagaagatgtattaaattaaagatactcttttccttagagattattttagaaaagtttaaattagcatttgggcaaattatgagtaaagataaaagaaatatccaggtaattcaatcccaatatataccatctactttgtctgaatatgggtatacactgttttattgtgctatactttatggagttttgcagatactgtgtttttcacaaattgaacgtctgtgtcaatcttgcattgaacaagtatattggtgccatttttccaccagcacatacttggtttgtgtctctgtgtagcagtttggtaattcttgtaatatttcaaattttttcatactattacatctgttaaagtgatctgtgatcactgatctttgatgttactactgcaattggtttggggtgccatgaaccatgaccataagacaacaaacacttaattgacaaatgtgtgtgttatgactgcttcaccaaccagcagtttccccatctgtctttttctcctcaggcctccctattccttgagacacaacaatatcgaaattaggccagttaataaccctacaatggcctctaagtgttcaagtgaaagggagagtcgcgtgtatctaactaactttaaatcacaaactagaaataattaagcttaaagcccagatgtgctgaaagctaggcctctcgcaccaaacagcctagttgtgaatgcaaagttcctgaaggaaattaaaagtgctactccagtgaacacatgaatgataaggaagtagaacagctttactgctgatatgaagaaagttttaaaggcctgcatagaagatcaaatcatttacaacattcccttaaatcaaagcctaggccagagcaaggccctaactctcttcaattctatgaaggctgggaggtgaggaggctgcagaagaaaagtttgaagttagcacaggttggcttatgaggtttaaggaaggaagccaaccccataacataaaagtgcaaggtgaagcaataagtgctgttacagaagctgtagcaagttatccagaatatctagctaagatcattgatgaaggtggctacattaaaaaagagatcttcaatgtagacaaacatcattatattggaagaagttgtcatctaagactttgatagctacagaggaggagtcaatgcctgacttcagaacttcaaagaacaggctgactctcttgttaggggctcatgcagctggtgacattaagctgaagccaaagctcatttaccatttgaaaatcctagggctctcaagaattacactaaatatactcaagtgaaaggaagagttatacatctctcattttaagtcaaaagcttgaaaaaattaagttttagtaaggaaggcacgttgaacatcaagacaggctgaaagctcgacctcttgtaccaaatagcccagttctataaatggaacaagaaagaatggatgataagacatccgtttatagcatggttgactgaacattttaaggccactcttgagacctactgcttagaataaaagattcttttcaagataatactgctcattgacaacataccttgttacccaagagctctggtggaatgtacaaggagattaatgttctcatgcctgtgaacacaatattgattctgcagcccaatggatcaaggaggaatttcaactttaaagttttgttatttaagaactacattttataaggctatacattctatagatagatagtgatttctctgataggtctgggcaaagtaaattgaaaatttactggaagtaattcaccattctatatgccattaaaaacatttgtgattcacgggagaagatcaaattatcaacagtaacaggagtttggaagaagttgattccaatcttcatggatgactttgaggggttcaagacttcagtagaggaagaaattgcaaaaatggtggaatagcaagataactagaactagaagtggagccaggagatgggactgaactgctgcaatctcatgataaaacctgaatacatgaggagttgttccttacggatgagcaaagaaagtggcttctcaagatggaatatactcatgaagatgctgtgaacactgtggaaatgacaacaaaggatttagaatagtacataaacaaagttaatagaaaagcagcagggttgcagaggaatgactccaattttgaaagaagttctactgtgagtaaaatgctatcaaacaacattgcatggtgcagagaaggctcttgactttgtcacttagtcacttgatgtggcaaacttcattattattttcttttaagaaattgctacagccacctcacccttcagaaaccaccgcccatcgattagtcagcagccatcaaaatagaggcaagaccctcaaccagcaaaaagattaaaacttaccggaggctcagatgatgattagcatttttttttttttttaaactttaagttctggggtagatgagaaaaaagtgctggtttgttacataggtataaatgcaccagggtggtttactgcacccatcaacccatcatctacattaggtatatctcctgatgctatccctcccccaggcccccaccccctggcaggccctggtgtgtgatgttcgcttccctgcgtccacgtgttctcactattccactcccacttataagtgagaatatgcggcgtttgattttctgttcctgtgttagtttgctgagaatgatggtttccagcttcatccatgtccctgcaaaggacatgaactcatccttttttatggctgcacagtattccatggtgtatatgtgccgcattttctttatccaatctatcattgatggacatttgggttgcttacaagtctttgctattgtgaatagtgccacaataaacatatgtgtgcatgtgtctttgtagtagaatgatttacaatcctttgggtatacactcagtaatgggattgctgggtcaaatggtatttctggttctagatccttgaggaatcaccaaactgtcttccacactggtttaactaatttacacacccaccaacagtgtaaaagcattcctatttctccacatcctccccagcatctgttgtttcctgactttttaatgatcgacattctaattggtgtaagatggtatctcattgtggttttgatttgcatttctctaatgaccagtgatagtgagcattttttcatatgtttgtctgccgcatcagtgtcttcttttgagaagtgtctgttcatatccttcgcccactttttgatgaggttgttgttttcctgtaaatttgtttaagttctttgtagattctggatattagccctttgtcagatggatagatagcaaaaatttcctcccattctgtaggttgcctgttcactctgatggtagttttttatgctgtgcagaagctctttagtttaattagatcccatttgccacttttggctttagttgccattgcttttggtgttttagtcctgaagtctttgtgtatacctatgtcctgaatggtattgcctaggttttcttctaggggttttcatcattttacatcttaggtttaagtctttaatccatcttgagttaatttttgtataaggaagggatccagtctcagttttctgcatatggccagccagttttcccaacaccatttattaaatagaggagcctttccccattcttgttttccctcaggtttgtcaaagataagatgtttgcagatgtgtggtgttacttctgaggcctctgttctgttccattggtctatatctctgttttggtaccagtaccatgctgttttggttactgtagccttgtttgaagtcaggtagcatgatctctcaagccttgttctttttgcttaggattgtcttggctttgtgggctcttttttggttccatgtcaaatttaaagtagttttttcccattctgtgaagaaagtcattggtagcttgatggggatggcattgaatctataaattaccttgggcagtatggccattttcacgatattgattcttcctatccgtgagcatggaatgttcttccatttgtgtcctctcttgtttcattgaacagtggtttgtagttctccttgaagaggtccttcacattccttgttaagttggactcctaggtattttatcttttttgaagcaattgtgaatgggagttcactcgtgatttggctattattggtgtataggaatgcttgtgatttttgcacattgattttgtatcctgagactttcctgaagttgcttatcagcttaaggagattttgggatgagatgatggggttttctaaatatacaatgttgtcatgtgcaaacagagacaatttgacttccactttttctaattgaataacatttatttctttctgttgcctgactgccttggccagaacttccaatactgtgttgaataggagcagtgagagagggcatccctctcttgtgctacttttcaaagggagtgcttccagtttttgcccattctgtaggatagtggctgtgcgtttgtcataaatagctcttcttcttttgagatacgttccatcagtacctagttttttgagagttgttagcataaagggctcatgaattttgccaaaggccttttctgcatctattgagataatcatgtggtttttgtcattggctctgtgtatgtgatggattacgttcattgatttgtgtatgttgaacaagccttgcatcccagggatgaagccgacttgatcgtggtggataagctttttgatgtgctgctggattcggtttgccagtattttattgaggattttggcatcgatgttcatcagggatattggcctggaattttcttttttgttgtgtctctgccaggttttggtatcaggatgatgctggcctcataaaatgagttaggaaggagtccctctttttgtattgtttgcaatagtttcagaaggaatggtaccaattcctctttgtacctctggtagaattcgtctggtcctggactttttttggttgctaggctattaattactgcctcaatttcagaacttgttattggtctatgcagagattcaacttcttcctggtttagtcttgggagggtgtacgtctccaggaatttatccatttcttctagattttctagtttatttgcatagaggtgttgatagtattctctgatggtagtttgtatttgtgtgggatcagtggtgatttcccctttgtccttttttattgtgtctgtttgagtcttctgtcttttctatctattttgttgatcttttccaaaagccagctcctggattcattgattttttgaagggtttttcgtgtctctatctccttcagttctgtagtgttcttagttatttcttgtcttctgttagcttttgaatttgtttgctcttgttactctagttcaattgtgatgttagggtgtcgattttagatctttcctgctttctcttgtgggcatttagtgctataaatttctctctacacactgctttaaatgtgtcccagagattctggtacattgtgtctttgttctcattggcttcaaagaacatctttatttctgccttcattctgttatttacccagtagtcattcaggagcaggttgttcagcttccatgtagttgtgtggttttgagtggtttttttttttaaatcttgagttctaatttgattgcactgtggtctgagagactgtttgttatgatttctgttcttttgcatttgctgaggagtgttttacttccaatatgtggtcaatgttagaataagtgcaatttggtgctgagaagaatgtataattctgttgatttgggtggagagttctgtagatgtgtattattaggtctgcttggtccagagctgtgttcaagtcctgaatgtccttgctaatgttctatctcattgatctgtctaatattgacagtggggtgttaaagtctcccactattattgtgtgggagtctaagtctctttgtaggtctctaagaacttgctttatgaatctgcatgctcctgtagagggttcatatatatttaggatacttagctcttcttattgcattgacctctgtacgtaatgcccttctttgttggtttaaagtccgttttatcagagactaggattgtatcccctgctttgttttgctttccatttgcttggtaaatattcctccatccctttattttgagcctatgtgtgtctttgcatgtgagatgggtctcctgaatacagcacactgatgggtcttcactcctctttatccaattggccagtgtgtgtcttttaattgggggcatttagcctatttacatttaaggttaataaggttatgtgtgaatttgatcctgtcattatgatgtttgctggttatttgactattaattgatgcagtttcttcccagcatcgatggtctttacaatttggtgtgtttttgcagtggctggtaccagttgttcctttccatgtttagtgcttccttcaggagctcttgtaaggcaggcctggtggtgacaaaatctctcagcatttgcttgtctgaaaaggattttatttctccttcacttatgaagcttagtttggctggatatgaaattctgggttgaaaagtcttttctttaggaatgttgaatattggccccactgtcttctggcttgtagggttgctgtcgagagacctgctgttagtctgatgtgcttccctttgtgggcacgccgacatttgtctctggctgcccttaacattttttccttcgtttcaagcttggtgaatctgatgattcattgtgtgtcttggggttgctcttctcgaagaatatcttagtggtgttctcagtatttcctgaatttgaatgttggcctgtcttgctaggttggggaagttcttctggataatatcctgatatcctgaagagttttctccaacttggttccattctccccttcactttcaggtaaaccaatcaaagtaaatttggtgttttcatatagtcccatatttctcggaggctttgttcatttctttttactcttttctctaatcttgtcttcatgctttatttcattgagttgatcttcaatctcggacatccgttcttccacttgattgatttggctattgatacttgcgtatgcttcacgaagatcttgtgctgtgtttttcagctccatcaggtcatttatgtttttctctaaactgcttattctagttagcaattcctctaaccttttttccaggtacttagcttccttgcattaaattagtaacatggtcccttagctcggaggagtttgttattacccacgttctgaagctgacatctgtcaatttatcaaactcattctctgtcctgttttgttcccttgctggcgaggagttgtgatcctttggaggagaagaggcgtgctggtttttggaatgttcagcctttttgtgctggtttctccccatcttcgtggatttatctacctttgacctttgatgatggtgaccttcagatggggtctctgggtggacgtgctattcctttctgtctgtctgtttgttattttccttctaacaaacacccaggcctctctgctgtaggtttgctggaggtctattccagacgctgtttgcctgggtattatcagcagaggcttcagaacagcaaagattgctgcctattccttcctctggaagcttcatcccagaggagcacctgccagatgccagccagtgttctcctgtatgaggtatctgtcagcccctactgtgaggtgtcacccagtcaggatacatgggggtcagggacccacttgaggagagagtctgtcccttatcagagctcgaacactgcactgggagaaatgctgcgctcatcagagctgccaggtggggatgtttacgtctgctgaagctgtgcccacagctgccccttccgccaggtgctttgtcccagtgagatgggggttttatctgtaagtaagtctgtgattggggctgctgtctttctttcagagatgccctgcccagggaggagtaatccagagaagcagttggccttgctgagctgcagtggactcagccctgtttgaacttcctgctggctttgtttacactgtgagggtaaaacaaacagcctactctagcctcagcaatggcagatgcctctcccctcacgaagctcgaatggcccaggtggacctcagacagctgtactcgcagtgagattttcaagccagtggatcgtatcttgctgggctctgtgggagtggatcgtatcttgctgggctctgtgggggtgggacacaccaagccaggcactggagggaatctcctggtttaccagttgtgaagactgcgggagaagtgcagtatctgggccagagtgtactgttcctcgtggtacagtctctcacggcttcccttggctaggaaagggaaatcccctgaccccttgtgcttcctgggtgaggcaacgccacaccctgctttagctcaccctttgtgggctgcacccactgtccaaccagtcccaatgagatgaaatgggaaacgcagaaatcccctgccttctgtgtcaatctcactgggaacagcagaccagagctattcctattcagccatctttccagctcttgtaagtacattgttgtttgtttagacctaatgctattgcacactaaatagactatagtataaagtaaacacaacttttatatgcactgggaaaccaaaaagtatgtgtgactccctttattgtggtaatctggaactaaactcccataacgtctctgaggtatgcctgtatttgattccatgtgtcatttcctacaagctctttggttggtttgcaaaggatgtttaataactcaatagaaagtagaaagcaaatgtacatagataaaggtttgcttcttataacatgcctgagaaacaaaggatgctagaagggactttaaacctcagctaagataactgaagtccagagaaacttcattatcatagagccaaataatagaattgagattagaacacagctatcttagcccaagtctaatatttgtcctattttgagatcctgccttctatgtcgtaaagaactatagttttctttgatgtgctgaagcaaaatatattttttaataaactctctcaagagtttcaccataaaaagattagatgtcaagttgccagaaccctaaaatatattagtttaaataaaattagatgaattgcttttgttagaaggtttttgcatagcaacttccaaaaacactaaatttatggtgaatgtctgaactatttacttgctatttatttctattaacttcaatgacttgagttataaaatgctctagaaactattgaaaataattaacttgaaggtgcttcattttctgatatagcaacaattttcaagcaaattgcattttttaactgaggtaccatactaagcacttattgactggcagaacttaatattgtcattaggatttatttgatagctattcatgaggttttcacaaacagaagaaagacagttatcagtgcattgctatgaaagcaaaagcaaatatgaaatgattaacaacgaattattactaggggaggtaccaacaattcccattaaggtaaaattggtaatttggtttgtctaataggaagcaaattttttgggggataaacatttttttggggctaaacattttcctctgattattttcacttattttcactttatgaaaagaaagagaaatcaatcctgctttaagttttgtaatacattgccaagaataaaatttcaaataagcaaacttactacaaaaagtgtatacagacaatgaagaaacaccaccacttatcactgctttattcacaaatggaaacttacctgcaatggactgaaatgggtccatcttggccaaactgttcttttgttttatggacttggccgatgaagtcaataaatccttctccggactttggcactccttgctctggccagtcagtgaactggaactgccttactgttcgggactggccgtcctttagaaggaaagccacatacccggccgcaaaggaagacgccaggaggattcagcaagcatacggaccacaagaacaatcattttcatttcccgaaaacaaaaagggtagaaaaagttaggaacatgtttaaatagaaacttagttatggtttatctgctataaatattgtccacactcacatacctttaaatcctaaatttatttactcttgaaatcctaaatttatttactcttgcagtgcccagttaaaaacctggttctcgttagtagccatccacatagttcccccattaacaaatgtttctgagacccaaagtgggggttcgtaaccattcatcatgtctgcattccttccaaaatggaacatataaaatggaacatatatattccatttcaaaaatttcagaaactaattactttgtaataaatattgaaacaagcacctaggcatgtcatccagaccagagcttttgcagttgtcgcaataacttcacatctgctgtgcttgcgtatttctaccgttgtcaaatgacaaatggtgaaatttaaagtatctgacacaaacccggtagttgctgttaacctggatgccccccatgtctcagaggaataccatttctagccatggcaggggacatagcatgaaccatatgactgtgctgttaagtgggaagtaaagcatccctcaaggataccaacgactattagcaaacaaatgcccttttctgaaaaagagctctccctggctgaccacaggaattaacagtctgtggagagctttaacatagataaaccaaaaggtagaaaaaaaagccagattgaagagcagtctttcttttttagagtgattaggtaaaactgctctgactcacgaagtatatctgggttgaaaagaagacactaaggcatttctgatcttctgatcccttgtggaaatttaaggtgtttctagaagtacaagaaaagtggaagggagcctctgtttatagaagcagaaataatacattgcccatcaaccttctcccctgactcatcagcagagagaaataatccaagcttagagagaccgatctcatttctcatttgaagaggtcctactcctaaatggtctcttctcattaaagagccttcaacttgttcctccattgtttctgttaacacattatttcctcatcaaactttttttagatacacgtgtgcatgttcccaaggttctgggtaagtgaacagggactcaatcctttatcattcactcatattgagaagagagaggatctcagtgtgagatgagcactcatcacctcgcctggtggttttcacagggacatgccagattcctgactgatgttatttggggatggagataaacaggaagatgacaccaagtgtgtgggaatactgagaaatagagaaaactatttggccccataagtactttatggatggttaccatggaagcatgatttacttccctctgtttctggaaaagatttggaaagcacaggaaggagacccagaagctaggtaatacagatttattctcctctgaatgtcctggggatttcatttctgaccacagttgctttcaatagcaagaagaggtcatgtgtgcaaataccttctatttggaggagagactgcctgacttcatttaaaggttacctgtttaacaatactgtaattttcaacccagaattgcatatccagccaaattaagcttcataagcaaaggagaaataaaatcctttacagaaaagcaaatgctgagagattatgtcaccaccaggcctgccttacaagagctcctgaaggaagcactaaacatggaaaggaacaactggtaccagccactgcaaaaacataccaaattgtaaagaccatcaacgctatgaagaagctgcataattaatgggcaaaataaccagccagcatcataatgacagaatcaaatttgcatataacaatattaaccttaaatgtacatggactaaatgccccaattaaaagacacggactggccaattggataaagagtaaagacccatctcacacgcagagatacacataggctcaacataaagggatggaggaagatctaccaagcaaatggaaggcaaaaaaaaagagcaggggttgcaatcctagtctctgataaaactgatgactttaaaccaacaaagatcaaaagagacaaagaaggccattacataatggcaaagggatcaatgaacgaagaagagttaactatcctaaatatatgtgaccccaatacaggagcacccagattcataaaataaagcaagttcttagatacctacaaagagacttagactcccacacaataataataggagactttaacaccccactgtcaatattagatcaatgacacagaatattagcaaggacattcaggacttgaagtcagctctggactaagcagacctaatagacatctacagaactctccaccccaaatcaagagaatatatattctcaacaccacattgcacttattctaacattgaccacataattggaagtaaaacactcctcagcaaatgcaaaagaaagaatggaaatcataacaaacggtctctcagaccacagtgcaatcaaattagaactcaagattaaaaaaaaaaccactcaaaaccacacaactacatggaagctgaaccacctgctcctgaatgactactgggtaaataacagaatgaaggcagaaataaagatgttctttgaagccaatgagaacaaagacacaatgtaccagaatctctgggacacatttaaagcagtgtgtagagagaaatttatagcactaaatgcccacaagagaaagcaggaaagatctaaaatcgacaccctaacatcacaattgaactagagtaacaagagcaaacaaattcaaaagctaacagaagacaagaaataactaagaacactacagaactgaaggagatagacacacgaaaaacccttcaaaaaatcaatgaatccaggagctggcttttggaaaagatcaacaaaatagatagaaaagacagaagactcaaacagacacaataaaaaaggacaaaggggaaatcaccactgatcccacacaaatacaaactaccatcagagaatactatcaacacctctatgcaaataaactagaaaatctagaagaaatggataaattcctggagacgtacaccctcccaagactaaaccaggaagaagttgaatctctgcatagaccaataacaagttctgaaattgaggcagtaattaatagcctagcaaccaaaaaagtccaggaccagatgaattctaccagaggtacaaagaggagttggtaccattccttctgaaactattccaaacaatacaaaaagagggactccttcctaactcattttatgaggccagcatcatcctgataccaaaacctggcagagacacaacaaaaaagaaaattccaggccaatatccctgatgaacatcgatgccaaaatcctcagtactggcaaaccgaatccagcagcacatcaaaaagcttatccaccacgatcaagtcggcttcatccctgggatgcaaggcttgttcaacatacacaaatcaataaacataatccatcacatacacagaaccaatgacaaaaaccacatgattatctcaatagatgcagaaaaggcctttggcaaaattcaacaccactttgtgctaacaactctcaataaactaggtactgatggaacgtatctcaaaataagaagagctatttatgataaacgcacagccactgtcataacgaatgggcaaaaactggaagcattccctttgaaaactggcacaagacagggatgccctctctcaccactcctattcaacacagtattggaagttctggccagggcaatcaggcaagagaaagaagtaacgggtattcaattaggaaaagaggaagtgaaattgtctctgtttgcagatgacatgattgtatatttagaagaccccattgtctcagccccaaatctcaagctgataagaaacttcagcaaaatctcaggataaagaattaatgtgcaaaagtcacaagcactcctatataccaataacagccaaatcatgagtgaactcccattcacaattgcttcaaagagaataaaatacctaggcatgtgaaggacctcttcaaggagaactgcaaaccactgctcaaggaaataagagaggacacaaatggaagaacattccatgctcacggataggaagaatcaatatcgtgaaaatggccatactgcccaaggtaatttatagattcaatgccatccccatcaagctaccaatgactttcttcacagaatgggaaaaaactactttaaatttgacatggaaccaaaaaagagcccacaaagccaagacaatcctaagcaaaaagaacaaggcttgagagatcatgctacctgacttcaaacaaggctacagtaaccaaaacagcatggtactggtaccaaaacagagatatagaccaatggaacagaacagaggcctcagaagtaacgccacacatctgcaaacatcttatctttgacaaacctgagggaaaacaagaatggggaaaggctcctctatttaataaatggtgttgggaaaactggctggccatatgcagaaaactgagactggatcccttccttatacaaaaattaactcaagatggattaaagacttaaacctaagatgtaaaatgatgaaaacccctagaagaaaacctaggcaataccattcaggacataggtatacacaaagacttcaggactaaaacaccaaaagcaatggcaactaaagccaaaagtgacaaatgggatctaattaaactaaagagcttctgcagagcaaaaaaaaaaaaaaaaaactaccatcagagtgaacaggcaacctacagaatgggaggaaatttttgctatctatccacctgacaaagggctaatatccagaatctacaaagaacttaaacgaatttacaggaaaacaacaacctcatcaaaaagtgggcaaaggatatgaacagacacttctcagaagaagacaccgatgcggcagacaaacatatgaaaaaatgctatcactggtcattagagaaatgcaaatcaaaaccacaatgagataccatcttacaccagttagaatggcgatcattaaaaagtcaggaaacaacagatgctggggaggatgtggagaaataggaatgcttttacactgttggtgggtgtgtaaattagttaaaccactgtggaagacagtttggtgattcctcaaggatctagaaccagaaataccatttgacccagcaatcccattactgagtgtatacccaaaggattataaatcattctactataaagacacatgcacacgtatgtttattgtggcactattcacaatagcaaagacttgtaaccaacccaaatgtccatcaatgatagattggataaagaaaatgtggcacatatacactatggaatattatggtgagtgagtattccataaaaaaggatgagttcatgtcctttgcagggacatggatgaagctggaaaccatcattctcagcaaactaacacaggaacagaaaaccaaacactgcactcaaaagtgggagttgaacaatgagaacacacggacacacggaggggaacatcacacactggggcctgttgcgggtttggagtctaggggaacgatagcattaggagaaatacctaatgtagatgatgggttgatgttgcaccaaaccaccgtggcacatgtataattaaattatgtaacaaacctgcatgttctgcacatgtattcaggacttacactccaggagcacagacaaacagcaaatgtagtagctaagaaaattatacaatcacagggagactttaaaaaaaaaaaggtgagcaacttccggtttcaatcttcttttgtttattgtgatcagatttaagttgtgcatgtgtggaataggaaaggtgtctctgccattggtggggcctggtgccttttctttatcaccaggaatagttggtgagtttactcaaaatgcactttctattttcactcacatacctagcttcaaattctgaaagagcactattttttttttttttaaacggtggggcaggttacactcaagacctagagatttaactgctgccttgaatactgtcaccttcagaatagttaatataactttctgggattaacaggtctgtcacctaggccaaccctcctgctaaccaatttctctttcacttaaggtcaacagccagggccaggctttggggattagcagacaatctccaaacctaagtttggagaaagctgctttccagaaaaaacaatggatcaactaaatagctttaccctggagttttattcaacccacccactgtgacagttccaaacacaaggcaggtctttgaactgacctggtctcccttaagatgtgtttgtaatcatgggttgaaagtggccaaaggcgaagatatcagagtttatgcatagaacatcttacatcagggctgaaccttggactcaacaatccagataagaaatgcaggatgaaaattagccaacaagggtcatgggagcacagctctcatggacagacacattagcacactgaggaataagccatgccaggaatcaaattagaatgtgcaaagcttgtcagatttttctaaagaatgccatttgctctgcggttttaaaatcataccaaattaacctctgggtccatatgacctaaagggctttgcaaaacaacaacatatttagagcctcaagtaatgaagaagtcaaaaaagctccaaagagcatgagctgagaaggtgaatgtaagcacagccaaccaatcagtaaacacttcccagcacgaacactcaccaagtgcatccccaaggttgagctgccagatgttatgtttgaatgaaagccaaactaaggtttgtgagaaagcttgccagacagaggaaaagttactcttacatattaaacataaaaaaaaacgttctccagaatgaatgatttctctttgggacaacagtcaagtggcaagtgcttctcccagagagagagagagagaggtatcttagactacttttcagctaatggttaagagttgaagactgtgccaacttaccctggcatctgtgaccttgaattcccttaggatatactgtggcatgttgtactcagccatgggatctacaacaaagtactggtatcttgcagaccgttctgctggccagtattggtgacatttctcctaaaaggagagaagattaatgttaaactatgcaaagtataaagaacattctgtatattatctatctatctatctaatctatctaatttccttatcccattaataaaatttcaaaattcaaggcaattccaattgcatatgactcatttcctcttagaaaccatgagctcccttcatagggaaaccctttggttcagtatttgcctatggcatccagcacggtctctggcagatagtagctgcttaatatacacgagttgaattgagaattgaatactttcatagggtaagcatcttcatacctacaagttatccaaataattacatcagtccttggacaatgctggccatgacaataacacattgcaccaccacagcatacttgcaccactatggtttggaatgaagagaaccatcagtatggacatagaaagaaacctccgaattgatttgttccaatcttacttgtcaaggaaacgaggggcccagtccattttaatgacttggctaaaccctgcagagtcattggccaaatcagagtaagtcagttactttcctcgtctgatattctttttgttctctccgggggctctacaagttgggctttagctgcacttctatttaatttacacaaagaagacagaaagaaaatatctgaagcaaatacgaaataatgcttacatcaagtcaatctaagaggtatctctaaataatattaggtcatagtggtagagcagtattaatagtagaaaccttaagtatttctaatactattttatgtgtatttcaaaaaaaaacaaaccacttttttcaaaagtggatctgggattaccaggttatatccttagaaaaactatgttgctttccaacactttattcaatgggagtgaaaggtaggcaagtaagaatttgcctcaggaagaaaagaaagtcaagttccttcataagtagaaatgatggcacatcaaactctagcctgtccagaacaaaaggcagtaagaatatgctaaaagaagtccgacataagtcaaacggggacacctgctactcatttgtctccatgcttgtgcttcactggaaacaaatcactagatctttctttaaaacacataaatttaaacacttgatgtggctttacaaatttagaaactaacaaggaatgatggtccggattatgtccagagtgcactgcatttcaaaaaaaatgatctagcacaagagttattgaaacaaagtcttcatttctccacagagtaaatgtcttatgaggagacacacaagggccacacacttactctgcccatttcacgcagcttggtgagcatcacaactatggtggaattgtgttcccagagcatccgccagaagtcttcagtggtctctgccaagggcccctgggtagcgatgtaggctttctgttgtctgaattacagagaatgaaaagaatgtgttaaagtatttagagaacatgcaaaagctcacactggatacataaacatcaacctgctaataaaaaacgaaaacatattattaatgcaattgaggtaaattcctgctaagattaaataatcaaataagagcatttaatacattttggggacttcgcaaactaaattgcttgttaatattatgatgtatgtctttatcattattatttgaattttagcgcaatgctaatagctcaatttcattgtcatacaaattacttaagaaacacttagatgtgcagcttcattttctagaaattattctcacacaatctattaaatttatgaaatatggtacaaaacagattctttattaactacttacatatccaattggcttatgaaagaagagtgcagaaggccagattaaacacttcataactactactcctaactcctatccaaaataacaaaaaaacaaataccaagggactaaatgatgacctatgcagaaagaaaatgtctttgaatggagatgaaatttattctggttattaaactagggcacatgtaaatatcaaggctttggatagtcaggggagcaaaagtagatacctgtatccatcaataaaactggcattgatgtaatcagatccttctactccacggataggctgcaggcatacccttgtggattcatatggcataatattaacaaggcgatttttgaatttattacatggaagattggcactgataaaccttgaggtgtgagcttttgagctggctagacgctgttgaataggaaaaaaaaaaaaggaaaaacccaacaaagatcattttcacctacagtttgaatgcagtgtaccccagatttcccttttagatataaatcttttgtttacttaaagtaaatgactattcaaattgtactgcttttcacatctacctaatcactctctatagcctattggatttctatatattttctgaaagtatagtctctcaagttaggagacataagggctcaagatattgttaggaagcaaagaatagaagaggaaaaggggaggaatacattttataatcatacacctgagggaaaggtcaaatgaatcttgtacttcacaaatttgaaaggttaaagtaaagccacgactcaaagacaaacccagaatgacttgctcctgaataaccacatcacatccaataccataccttaaattcgagctccattcctgtgacattctctcccgtttctatttgtgtcagcttctgaatgtaggcatacaagtttctagctggcacttcggtatttccacaagtcactgcttctaacagtgcatcatggataaagatgtattggtcttctgtttgaaccatatagttcctctgggctctcattaaagttacatggccataaatatctacagttttttcatgctttattctttctaacatggcatctatgacgatgaagcaaccagtccggccaactcccgcactatgaggaaaatagagaagaaaagcccaaataaacctatcagaaaatcaatacataataaaagtatttttattattcttattaactagaccttacatccattacttctactcaaatagctattgggatgactttgtaatactctaaagtcaaaagtattatctaggcaccataatcagaggacagggaacaaaagactgagtaaaattagtttagttttaaaatgtaaaaaatattaaatccataatcactatgttccttgatcatgcaatacaaagtgaacattatttcgaaaacttttgaagtcattatgaaaaaaatacaaacatttagtctgtccatatttagaagatagttttatatattggtccagatctggctaggctatagttcttgcaaactctctcaatctgttttcgtcccatgtacaaaacataaagattgtttttacagtctcaagctaaacctcgcatgcttcctatttatcaaacccttcaggctgaggacatttatgtgtcaagtatggttcaatccaaaatactttctcttcctgatcatgcgggtttatcaggctggtaaacatgtcatcaacaggaataggtatataataggtgtatattaccatcttaggtaacaggcaacagacagcctccttcatttgctacatgctatgtttcctgtcatctgtgtatctatgtgttcatttattgtccatccctcattgatctgtccatttcttcattcaataaacaatgaagtactctgctaagtgaaataggggatacgacataaagatgacttagatgctatctctaaagagctcagagtgtatcgaagggacataatactttatacacagctatttctaaacaagaaagaaaaaggatgtattagttttgtatatgatgtggcatttgaagtaggacttgaaggacaggaaggatgaggaattaaagatgttgtagtatgaacaaaggacggatggctttggtaatcacactgctggctctgggagctacatgtgaaattttcataggtctggcaaggcacctttgcaacgaagataccagaactccaaaacaaatgagttaatgctcaccagggtgcctgtctcaactgaaatggcagtttctgtttggtatcatagtggctgcaaggcagtaagagatcattttttttttaaacaaaataatacctttatttaactgctgaacagtgtatatcaaagctagcttgcatacaggagctctgtggtttacagactgggctaactagctgggaatttgatataaccactactttaaaataggttacttttttatgtcctatgccagagggctcctgaatactgatgccaagaatccaatcccaagtataaacccacaaattgacatgacattgatatatcatgcaaaagccttctgagacagagagtcctacaaatgatagcacataccttagcacagaccaattggcaacctgatgcaaacattaatatagagcaaagtcggcctggtggttccagttccttgagatccatgaagtctcattttatttagttggttctaaagaaacctgttagatggcgagttttccctgacattccccattcctaccctcccaggtggttttaatcatcctctgcctcagatccctggttgccctcaaatacccctttactacaattctaaccaaattatattattaatttagggcagccatccataaacaacagcatacatcttgagagcaggaactgcattaaaaaaaatatttgtgtgccctacacaaagcatgcagtaagtgctcaacagtgtttgtgaaataagtaaacaaattagtgactggcttgagatgcctgcagtaatgagcagcccgtcccggtaaggtaagcctacttaggaagcaggactcttcagaccatgcaaaatcctacatttgacaagggtttggaattatgtaaggagtacccgaggactcctctgcatagtgtttgatcaggaataaagagacaggaaaatcactttaagtagtctctttgctggtctcctgatatgccatcagattgcagttaaaggaacctaagtcagactcaacctggaaaagatttgtctttctgggtttctttcaaactccatgtttggcaggtcctgagactccaagtaacatctttcgttctttctgtgttgtctttctaaattgtcttcattgcagctgtgaatcgtttctcatggacacagttttatgcagttcttcccagtggaaaccacactgtaaaccttagaactgagccctatacatcaagtcaattctagataatggcaggactattttctcaaaatatgcatcagggaccattcaaatgtctggatgatgcatggttctatattctggcagaaagatactacagaatcttgcaaaattggtaggaataactccaactctaaacagtatcaaccttttcataatggtgattttttttttccaaaaaataagggaaaaaaatcaaatacgtgtgagtccaaatcatgaattgtgggatgaaaagaaataacagaggctatgacttgaacaaaacctattttttcccccacaattcaaaatattgttaactgcccaatcctgctattcatatggaagatagggaaggagctgacgtttggaacttaatgtgttaccttcttctaggatgaagaattcttgagggatttaaacattaaataagtgttttcgcttgaagcaagaccttgaggcttaaggtacctcttcagacatcaatggctgtgtgtccttgagaaagacattttaaccccttccttatattcccatatttcttaaatgatagtgacagttaactcttattaacgttaattttctagtgagtctaattatccagtaagtcttaaggctaaattaaaaataccaagtgttttgcaaacataatggaaaaggcagttactttctaggtacaaactccattttaacattcagtctctaaagctgacaatgagaaacaagcaatgtaatgctgggaaaattatgacagaattactttagaaacatttgagatttggcttttaaaatcttgctttcgtctactctctcaagctgctcttcctttcctctgccttctttccaataaatgtgccttatacctgaggagctttctgcgttcacatttatcatcgtggcaaatgagatggcaggcaagggccttcctaccacagtgcttgacacctaagaagcattcagtaaatgttggtttcctttccccttctctgacaacacttgggaactgccctgaagtcctacagtcatgcacgccatacctggatagcagagaagactcaaatgcaggttctgaggtgttaaaatttagcaccctgttcccagcacccccagtgcttcacaatgctttccaccatttaggtcagcagtcattgccaaatatggtgactttcctgtagagcgctcgtctgtgatatttcattggcagcatttgactatccctaatgcaggttcctagaaaagctttctatccttggttttaaggacactagtcaagggagtatgggaaacatcagatactcccttggggttaatggtagcaagggtggagattgtgtcattactccagacacaaaataatccaaaacaggtagtacacgaaatcagcccaaaataattgtatcatgatcctgtatcacggttccattgattctgtaacagggtagaattcctaccacgtttgaaatcgaaatcaaagatgaactctaaatgtcatcttcagaaatctactggcatccgttcagactgtgcctcagtatgtttcgttttgttttttttatttgactccagtgctaattctctacctgcctctctggattcttccatctgtatcaatttcacggattacatatctctgccagtccccaaaatgtagataatgctccaaaagttctgtccttctttctctcagtagtagtctccaaaggattcctaaagtgatgcctttctttttcagcacaagtggagatctatatttcaaactgtcttcaagtttatcaaaaataaagattctaagcttaatcagtatcttctcctttcaaatctgctcctcccactctcaggctctccttgacactcaggtttaaaactgaaaaatcatcttagactctttttgcctcttaccctgcaaaataataaattataaattgttatgtattcaaactccacgattatcttcaactccccatcagtggtgtgctagagctagcaaaagccaatccttacattttcagggattatttgctgaaataaatatattaaaaataaaggtaatatataaaactcattgtttcttaattgtttcaaattattttatgctcttgaggtgaaaacatcatatagagtagtccccttttatctgtggttttgactttctgcaatctcagttatttgcggttaaccacggtctgaaaatattaaatggaaaattccagaaataagttttcaatgacatacttttctgaaaagtgtggtgaaatctcaagccctccctttccatccagcccagggtgtgaatcaatccctttgtccagtgtatccatgctatacaggctgcctgcctgttagtcacttagtagccatctcggttatccgatggactgccctggtattgtagtgtttgtcttcaactaacccttattttacttgatggccccaaagtgcaagagtagtgatctgggcaatttggatatgccaaaaagcagctgcaaagtgcttcctttaagtgaaaaggtgaaagttttcaataaggaaagaaagagaaatcgtatgctgaggttgctaagatctatggtaagaatcaatcctctatatgtacaattgtgaagaaggaaaaagaaattcatgattgttctgctgttgcacctcaaactgcaaaagctacggccacagtatgtgataagcacttagttaagatgaaaaaggcattaaattttgggtgaaatacatgaacagaaacatgccatgactgatggcaagtgagcttggtactctctggggactcaggcatccactggggatgttggatcatatcccctgcggatagagggggactacactaataatgtgctggtgatcgtctctctctagtgacctcatgtttgtagcttgaaatcatccatgggaatatttacaccaaagaaatcaggaaatactactttttttctccccagagagcaggtttttacatatttaccagcacatatgactatgctaaagcatccattcccaccatccagggacaaagaggaagagttcctaactttgttcttccatccatatttgttgtattttcatgactctgtcgcctactattccacaaacatttactgagtgcctaccatgtgctgagacatcgaagaaggaatgagcagaacaaacgtgatctttcctgtcggagcttacagtttagtgggggaatctgacattaaataatcacatgaataaacatctaattacaaatctcaagcggcgctgtgaggcaaatgtgaaggatgctggtagagcacctttgaggaagtgccattgaaactgaaatctgttatgggctgaattgtgtttttcttctcaaaattcatatgttgaaacgctaacccccagtgtgactgtattggacacagggcctttagggaggtaattaaggttacatgaagtcacaaggtgggagctttaatcagataggatggatgtccttgtaagaggaagagacaccagagatctttttctctatgcatacacagaggaaaggccgtgtgacggcacagtgagaaagtagtcatctaaaagccaggaagagaggcctctcctgaaaccaactctgccagcaccttcatcttggacttccagcatcctgaatggtgagaaagtaagtttctgttgtttgagccactcagttcggagtattttgttatggaagccccagcagactaacgcaatacctaaaggtcaagtaactgtttgctaaataaagagggtggaaaagcttttgaaaagatatcctaaaaaaaagtgctagaatagacaacatagcacatttgaataactaacagaaagccatcggctgaaaggcagtgagggaaaaagagggcatgttccacatagttattttccattttagggactggctataacatttttattaaacttataaccacatcagcagcatttatttagaataattctgcctcacatgtttcacagtttatctttctgacatggctcatctattcttgagtttattttgatgcatctattggttggctggaatatgtctttgaataatgctttatataagatatgcatggatgccactttttctgatgccttatatatctgagaaaccctttgtgggtttctttttttctttacatatgaccaacaacttggttttgtgcaggattactgggctccaatattatctcttcaaactctaaatacattgcttcacggtctttgttgtcctttgacaaagtcataggccagtctggtttctggtcttttaatagtaatttttgccccaagtaattgggggttgtttctttaacttggaggttcaaaaatttcatctagatatgctttaggcattgatctcactgttaaaaccgcagggccctcaggtaatattttcattacaagattcttggctgttcctcagcactagttcaaattaaacatgttttatgctttcccacctctgggcgtttgtgacgctggaccttctacctccttctcatctgttgacatgtactttccttcaagattcacctcaactgctgcaccctgaatcaacatttccttttgatttattcctccttggactcttttgacaatttataactattttttcagcaactgccttactttagttttgttttctggttattatccttatgccagttggcgctctcctccagggaaaagacaacagcttcgttgtctctactgtttggcaatttccatgccagggaaattgaaggtgctcaactcgagtgacaaaatttataaaaaaaaaaaatttaaaaaactttaaaaataggaagccctctcccagatcaataacacataggggaacatttccccgaagcccccagcatgggaaaattcctttgatacatgtttacaaagataaagtaatgcttataatttgatgagatgcaaacaacctgtgcttatgcttcactccaattgctgagaaataacaaacctccggcacttatttttccttaagaaattgaatgttgaaaattcagagcttttaaaagtatcccagcctacttttgtttgaatttccaagttcccacagcagcatatatttattttgtttccttctccaatttactctttttttgttcacccatcagtatctgagtgcagtgcacctctcaaaatgaaggattgtacttctaaaagcaaatgcatttttctttgatcctgaaaaactcagctctccattgcagtgataatgacggaaccctatttagtgctgtttgtttttcatcatttcaacagccttcaacttgaaacatgataagaacagcaaaactgataaaccacccttatttttatctgttttctgtcagagtagttgccaagcactgagacagatttttctaaatatctttttaaaaaaggagtgcataaccctgtgcttcaggctgaggccagcacaatttagtacatttattatgttatgttacagaaaattccagcaaaaagagaacggcaagtttaaatggagtctagcattatgttggtctctgttatccctaaagtaaaatcaactttttattttccggtgaggacaactattccactaatgagaatcagaacacaaactctatatttgtttgacttcagcagcaaaccaaattattgctaaactttagtggttttttttttttttttaaatttcagtaagtgatagacgttccagtgtttacaagctgaaagactatgcaatccattaaacaagtatgcctactaggaaattgttattacttcaatattatcattcatccagttacaacatttgttttcaatttctaaaaacatgattgagttagtcccacgagttgaaacgggcttaatgtcccgtgatgtgatacagtagtaatgtgcaaaaagaaaaaattaagaggcatacagggactgttttatgctaaagtcattctggagatgtgtttaaaagttggcttttctgattaatgtggtggagttttaatgctgaccctttcctggtacttcactgatctggcaaagaaagacaatagaattaggatatttcacacatcatttagttgggtgccaagacagtaaaatatggactaaaaaaatcattgtgagcattttgtacatatgtcagcttataatttgattggatatagttcacctatcataatggtatatgaactacaagtatttgacatctatgagaaaagattgagttttacgactcaggtttataagattaattaggtgactcttttaataaaactgtgatgtgactctgatgaggctgccattgtgaaaaccttctttcattctttgataaaaatcaacatttaactttataagcagatactgggcatctctacgatatttggggttcactacaaaaaacagacccacagataggttagtttcttctagcatctcttttacctaggataactagagaaattatattaatttctttgacaaaatattcagctgtctaacttttatatattacaaaattaaaatgaaaaaaaattgaacaaattgtcattgatacgcagtcaaatttgtccatgctattcaacatacactatatccctatactaattaatatatagtagttatagcagttttaaggggtagttttgcaatcttcattaaaatttcaaatgcacatactctttgacccagcacctccaactctagaaatctagcacggaggtctatctacacatatgcacaaagagagtagaaagagattttattgtagcattgttgatgtagcaagttaacttagtaaaacaatcatggctagggaactagttgaataaactatggtatatcaataccatggatgtgatgtagcagttaaaaagaatgaagcgaatccatgtattgaccctctccaaaatagcatctaagacattgtcaagcccacttaaatatattgcagaacaatatatataacataacaccacttacattgttttaaaagtccattcaggattacatatctctatttgtacacatgttaatgcacaaaacatggtctgaaaagatacacaaatcagaatagttctgagaaggatcggtaatggtggcagtacagataaactttcactttagttgaagtatttttttgtagcttttttttttaacaaggataacataataatctaataatggaattaagaagaaatataaagcaatgggtaaaaagttactataataaatatcataattacagttcaataaagagttgaggctccaaagacacagagagaaaagatggaacctaattaactctagctcaggaatactgccttgctcagtgatggactgtcagaagtctgggtgatgttggcagctcctgtgtagcccagacttagtcctgccatctggtgctggcttttaaagagtggatatcagaaagtaaggggatataggagtcattgtagagaggagactgcttggcaaagagtaaaaaaaaaaaaaaaaaaaaaaaaaaaaaatctagagttagggagatgacccagagccatgatcactccagaaaggtaaaatgtagtacacttgagtggtgtcttctgaggataaaggaagttcacatttcatcaacagagaaggggcagaaactaagcacaaagttcccaaactgcctgataaggatccttgtatagaatactgaaagatcagggatgagctaccaggttatatccctttgggtgttttatttttccatgctgggtgaaaaggtaatttcctaaaaaaccaaaactccgtctcgagaaagaaaaaaaaaatccacatgggcctaatctgattttttttttttcaaatatgtagactcaaactaaaatcttccaaagacttctgcatgatcttggctttgtcccaatattatctgctgaacacactccctattattcttaaaatgtgattctcatgataaattagaaggctaatgtgttcgcgtaaagaacacctgaatatgccgcagcaggtctcattttacagatggatagaacaggccattaggcatggatagagcagactcagctggctctgataattggtagttgacttgaatctgaatagaggtcaatcaaatgatgctacggaagtttagagaactatatcattcacacagagattttccttgtaaaccataccagctcactccgtattctaaattctgtttagagtgatacaaaattgcccactttttgaaagaggagacaaccatttaccaggcctgccaagtaaagctgcgtgggttgtatactgctcaacccaaaggaagttacaatcacatggactacgtacaacgtgtgcaacctgctcagtccacacagcaggcttgtcattagaaatataaatgctattactcctgattcaggttaagcaagattcaaagagaggagccactggaaggtacttggagggcatttgaactttagcaactttgattagtttgtaaggcatatcattttcccacacagacaagattttactatgtacacaaatgccaggagttttttggtttttctttttaaaaaatgctattattgcccaggcatggtggctcatgcctgtaatcccagcgctttgggaggctgaggcggacggatcacgaagttaagagattgagaccatcctggccaacatggtgaaaccccgtctctactaaaactacaaaaattagctgggcgtggtggcacatgcctgcagtcccagctactagggaggctgagacaggagaatcgcttgaacccagaaggtggaggctgcagtgagccgagatcacaccactgcactccagcctggcgacagaacaagactccgtctcaaaaaataaataaataaaagaaaaaggctattatcgttatttaaatggtattgtccaatagtttggaaggctctaaatctgtggttccttgtttcattttgtccttttgtttgactcctgcaagcttttataaggcagtgagaatctcactctcaatacaatcagtttatgattgtttgcaacaccctagcaacctccagcaggcctttgtgttggttttgtagaggcctgttatggcttctgatccggcttcttaaactcatgggtttctgaattatgaatcagtatgcctatttatttatttatttatgaatgtatgaatgaatgaatgaatgaatgagatggagtctcactctgctgcccaggaggctggagtgtgctggtgtgatctcggctcatcgtaaactccgtttcctgggttcaagtgattctcctgcctcagcctcctgagtagctgggattactggcacacgccactacacccggctcattttccttatatttagtagagatggggtttcactatgttggccaggctggtctcgaactcctgacttcaggtgatctgcccgcctcagccccccaaagtggtgggattacaggcatgagccactgcacccagccagtactgcccattgcctcttctaacccttttgcctactcacattcgtatacatatacaaatttgagactccttctcaaaaaaaaatatatgtatatatgtatatatgtatatatgtatatatgtgtatatatgtatatatgtatatatgtgtatatatgtatatatgtatatatgtgtatatatgtatatatatgtgtgtgtacatatatatatatatatatatatatatgtttttttttttttgagaaggagtctcactctgttgccaggctggagtgcagtggtgcgatctcagctcactgcaacctccacctcccaggttcaagcaatcatattttttaaatatgtcttttatttattacataataaattgaaatttttaataccttatttatatttatccaaaacttagaagtttaagatcattgctaagtactccttattctttttttcactttttcataacttttctattgtaattataaggtgctagaatccatagttcatcaatgcaaaatgtaaaatgggattcacttccacaaagtcaaacacaagaagtaacagcaaaataaacagaaaaactttatgtaacacattcatccaatgaaataactatctaccatgactggtaatggttgtcctacaagatggacgaaaatttcatgaaataacaccaatacgaaaaatttaaataatagtaatgtttctacttttcaattataaatggctatccacataactgaattttcttctaatctgcttcaagacttaaagaattttctttttctttcctgtactaatcattgaacctcagtttctaataaattttggagcatctgggcctttgaactccttgaataaaggtactgttaaaatactaaggttttcctgtttgttggttggtttgactcaagtagttgcatatatttacaggcttaagaatttgatgaagatcacgtggctgtcactagggagctaagacttgggtccacgtctccccttccaccagactctcacttccaccaatgggagttttactatgaacagatgacagttttccttggagctccccagatggacccaaggtccacgattctatcaatcaatttaggctgtaagaatgttggtccaagagagaaatgctgttcctgtaattgtcttttattcatgaaacattagctctcccactctactgcactactgaaaaataaatgaattaagtggtttttaaagcactgccaaaataggtctttgtgaacctggtgatatagtttggatatgtgtaccctccaaatctcatgttgagatatgatcctcaatggtggaagtggagcctggtgggaagtgtttggagcatgggaggtggatcgttcatgaaggcttggtgccctcacggtggtaatgagggatattgagtttacatgagaactgattgtttaaaatagtgcggcacctctcctgtctctctcttgctcccttttgccatctgatacactggctccccttttgccttccaccaaacttcctggggccctcaacagaagcaaatgccagtatcacgcttgctgtactgcctgccagaacaggttgtaggccaaataaacctcttttcttcagactaacatacctggttatgtatcagctagttacatttatgtcagctctatctcttttagaatattttggtctatggttgaccttttagttcgagtggtatgcatacatactgacgaataaataagagctagtattaagtgtatttagaataacctactggtcatgtttaaggatgacagtagagaggacagggtttgcctctcatgcagaataatactagaagatgggaaacagttaagagactgtgacaccaaagagctgaaggttaatattcaataattcaactcaatggatgcaaaatgggagattcctcttctatgtatcaatcgccatgcagtgtaccccaggcatatatacattatatgttcaagtagtctgaacatgctgctagggactgtgagagcacggagacctgggctctgtcccagaggttcttattcagtaagtctggggtgggaccaaagattgtgcatttccaacaagttctaaagccatgctgatatggctggtcgctgggccacactttgggtaatgaggatacaggcacattgctaacatttttatatgtaaatacagacaaaaaggtgcacagaatacactcataataatgtacatatgtgtgtgtttacatacatacacataaatttaaaaaaatcaaaatctctcattcataaggattttttgtccttagcaatgtaaagttcaatggaaaggagagaccgcaaagggctgctttcaaaaacgcaaagtttgcttttcattttttttaagaccaaatactttactatctccagatacctgaaaatatatggaattatcttgtaataaaactcagatgcccaaagcccaccttttgagttttctttgcaagaaacaaccccaaatgcgagcaaatcagataccatgtaataagacctaaaagtatttttccaaagacagaaagaaaaatatctaagcaatagaacccagattggaaagacaccaaacaaagataacagaactatttttaagcctcattttatgaccaaggggcacagcaaaatagtttgaaatagaaagttttcatgctgattacatgaaatcaaaatacacactgttcaaaggcagccaacattattattttttaaatgcagtctagttcatgcaataagtttcagtgttctttcagtctgggaacatttcaaaatacattgcaggtacagctgggaaaactcagtgatacccctgtccagatctcagctattaggttataaaaatattttcacatttcctgcagatgtctagattcctttctttggtagtaattttaattcagacctcattattgacagctgtttgttctgatagaacttaattgctcttctaccagactcagctgcaggcaggctgatttcctttccttatagagtatattacatataaacacaggcaggaaaaaaataaccaattaactaaatacgtgtgcataaaatgattcattgagagctctgatcaagtaatgtatccaactgcaacataggtcaaaggaaattacagcacttatagtttacagtattaaatataattatatagaaatactcaaaagcactaaaatatatagatgatgagtggcagcatctgaaaatctacttttatcaaagaaatttataaaattactatatttgagtaactggaagggtatttattctgctgacggattaactcatggatatctattttacataagctatacgctacaaagaacctgagatgccttccataactgacaaagtcatgaggaacccagcatgctgtgggatcacactgcaatgccaacaattcttcttcgaagggcagagtttctggggacacaccaactcttttcctcattctccagtcactgctgtggatgagctgcttttcctaactttaccagaaaatgaatacaaattctttgaagttaaagctattccctctgtttgaagacaatgcctcattttagcagctcaccaagagatgcaggaatagcttggcaattttcattctatcaaatgccttggcagcctcactcatggagtctaggcctatttggagaccccaagctgccttccttactggactggaacccctgaagagggataaaccgagggctgaattcatcaaagaacatataagcagcaaatatactgcatttgagacaagcaatagttccttttattggctctgtctgttttggaaatggagagaatgtggtgagcagggaagaacaaactgctccttagtaaggaacccactcaaggaaaatgaagtttttttcttaatactagggacgctatatggtgcatcccttttcggggccaataaatgcttctctttgcagacttaatctacctcatatagggaggaagatattgggaataggatgcttattaccctgataattctcagggatgcagcatacatttccattaatactaggcataatgctaattacaatgcaagccccacactcaacatttacaaaccctgacaaaatgaatgtaagtatcctacagggtttggtatccacaaaatctggtcaatagcctactcccagtccctccctttcccctaagtaacaaaggaaaccaatacttcttggtctttgagagtaattctactaagtcccgtattttttagtctatacatacagatcattatacccttcagattcttgcatggtatgactcctggcatcgttttggattgtgacacttctactctaatgctcactttatttagtgtctgtttcacacatggcatagttctaagggaggatgcaatgtgacctcatagacaccatctccaaccacgtatctctaacggttgaaagttacagcctggggaagaaattcagttttggctcatggaattaaagacttactacactttaaaattccccccatcatttttttttttcttgaaggttcacttcttactggttaaaatagtttaaacataatttaaagtcctgactgagttgatgatactgactattttgttttcaattaagcataacagagcaaatggtctttgatgtgatgtactcattttatgaaagaaccaggctggcaaacaaaaattttatggaatttagagatactaactctggctcttccacctgcagcttgtatcttaaatacatcatttatttattcttccagagcctctgttttctcacctgtaaaatgtaaacctatttcctaagttttctatgatactgtcagcaaaatacattttaaataatagcttcttgatcaatgttaatttcagtactcttttttctatgaattgaggacctagaattgaatattttaattcagttagcctaaccacagagtagatatgcaaccttcctattcttgcatagtttattagacttctactaataaattttatgaaaccaatatttaactttattttctggtttaaatcctctcaggaaaaaaaaatgtaatataaaattgaatcagatttcttgtaatcccagcactttgggaggccgaggcgggcggatcacgaggtcaggagatcgagaccatcctggctaacacggtgaaaccccgtctctactaaaaatacaaaaaaattagccgggcgtggtggcgggcgcctgtagtcccagctactcgggaggctgaggcaggagaatggcgtgaacctgggaggcggagcttgcagtgagccgagattgcaccactgcactcccacctgggccacagagcgagactccgtctcaaaaaaaaaaaaaaacaaaaaaaaaaaaaaacaaaaaaaaattgaatcagattttagattcggcagggatcttagagatctggtggttctcaaagtgcggccccatgaccagcagcatcagcagcatgtaggaaactgttagaaatgcaatttttcaggccccaccccaacctagagaatcagaaactcaaggggtggggtcaagcagtttgaattttattatttcattatttttgagactgagcctcgctctgttgcccaggctggagtgcagtggtacaatctcagctcactgcaacttccacctcccaggttcaagcaattctcttgcttcaggctcccgagtagctggaattacagacatatgccagcaaatttataaaataattataaattttatagttttagtagagacagggtttcactgtattgcccaggctggtctggaattcctggtctcaagtactccacctgcctcagcctcccaaagtgccaggattataggcgtgagccaccccacccggccagctatttgaatttttaaaagcccctaggtgattctggtgcttgctaaagtttctgagccacccatcaagccattctcttgcattttacaggtggagagactcaggaacagagactaaaataaaatctctgtatttcagttgcattgctttgtttgtgtcaaagttctgttttcctccccttatctcaagtaccacttagtgtttgttccatcatttcttcctttccttaggcatatggctatcaatatgcatggtcttatctgacttccatttaaccaatttaactcaagctttccttttcctccaaaaagctcctcccattgcttactgcactaggtcagctcaatgtttgttaggaggctactctccaggttgtctgtggctctagaatgtttgtggtgtcatcatgtttattccaaaaataatcagtcatttcatttaagtaatgtaattcttagataaaatgacgagatatagttacaaaataaatgagttgtttctgtaaaaaccaagttaattactttggaaagatagacgtaaaagtaatttgtgtcccgtcatagccaataaagtaccattgaattaggtaagggtgacacaactgcaggtaaatggaaaaatatttataaacatctagatggattctaaagttgcttaactttagaaacaaactactgtttgctgttgatattaaaaacactaaatctgctaatcattggtcatactcaaataagagttcttagtcccaaattttaaaaactggtgaatctaatatacagttatgcatttgaggttaatgtcaactgtatacatacattttagggttctttgcttcacttgaggttttgtctaaatgatcaagtctaaactgaacatatagatcaaggttccttctgaatggtcttgattgctttagatctcttcatatatgatgattaagctttttgaaggagataccatactctataacccacagttttgcacagtgaagttgtaataaatatttactggttatatttatatatacattttattgaatgttgctaattgattagccaattacacttagtagttcatcatctcgttttattactgtgagccaaattatccaggctatgaaacatttcttttatgatagcacttcctggagtccttagagaaattccaaggggggacaaatagttctataaatttcctcttgaaggctcacaatgcattaggctgagaaaccctgctgtaaagaaaccagttaaacttacttttacccatacttatttgactacagaaattcacccccctgcatcaattaataatccatgattcaatgtgcacatatattgatgaggtatcccaaattttctaagtgattttcattcttatgttcaaacctttttttctgtttctgtagattttctcatacttcttataacccagaataggtgtgaattatgtatgccaattatgaatgcgtcagattaaatggtcaacatacggatttgtaaaacttagattggtaaaactgctatttttttctattttcttctttcttctcaatgaagtagcagaacattttaaatctagctctgctttcacagattaaaagaaaaattttagcaggggaatgtgaaacttagaatgtcaaataacaggcagtggtggaggctttgatgaactgagcctaattaaaagtaaaggtgctgagtgaaaattttaaaagactgcaagccaaatgttgctaaggacaatttggggtacaagctttccaaagagggaggtggttttaatactctgtaatcattttgaaacttcatgctataaaagacttcagatgtagaaaagcagtctaggtatcagattataacagcataggacacctagtctaggagcactcaacctggagtcgagaaagcagtaataaatgccctttacactacctctgtccatggaaattgaatatttacctgagataaggttgcccaggctattaaaatctcagatgttgaatggcagttatgtaatgagtttctttgaaaaacagaaaatgaattgccatttaacaaacactgcctggaatgttgataattgaagctgtgtgatgcgtgcttgggggttcattatacattctctccactttggggtatgtttgaaaatgaccaaactaaaaaaaattctgaaaaaacagcctcctttgttcccgcttaaggtaaagcactttctaagtgtacagaagtcccccacagggcagaaataacaaagaggatcgtgttcagacccactcaccttcttccaatagctaggactggactattggtttcttaagccatagccaaactgtgatatggtgaagctttagcagaaaaccatgtgacttgatgagattgcccatgcagaaatgcaggcaaagaattcagcaagaggtatgtagaccaccttgggaatttgtacctttgtacagtatgcaggccacaaagcttcactctaaaaatgacttacatgtagaattattatctcagattttaaagatgtgtttattcctaagcctttagaaaatataaacacaacaacaaaggcatacatacctatctcttgtaactggactacattcacagagctccttactaaattctggaagaggttttgctaagcttgtagctttactattgtaccctacaaaccaataagtttgagtttaattgaaccaagatagcaaatggatttcagactatagtacctcagagaaaatagtctgaaaccaggtcaatcattttcagacacacgaaagagggatgaaatattaaccatagattgtagaggaggatttttgtggtttgtaacatgattggttatggtttttcaaatctaagtagcaagcatgagtccagactgagaaagcctctgcccaattgattagaattggagttggttcaggttgacaaagtgagagtttaggatgtgaagaatgactgaccacctataaaccaaaatttggactgaagttgtttcttcaaagaaacagatttctagaaaaccaatcaccatcatcataatcatcatcagagtaaacaagcatttaatctatctgattttatccagttttcctctgagaagatgccattggcaaatgaccagactgttctctacctttctacagagctataacttcagtcaagtgagtgacttgcacaagatcatacagttttatccaatatctcttatttttctacatttctacaattatcatttttttgatcctgaaagctaagtatgtagtgaaagtcatggaattcagagttgtttttattaagacacacttaaaatgaagatttaaagatccaggagcttgatttatcagtttaacattttaaaattgcctactatatatgcaattgcctactgctttaggaagtatttgatttttactagggtttttgagcatgtgtaaaacatagattatatctggagaccattcgtggtctctgtttgtccatacaaaaatccaacaaccctagctcttgataaaatttggaggcttaccattgtgaccatttgaggttgcatcttatatacatttatcttctgcattcatttacagtattcactcttagcttggaggacagtataatttaaaaaacccagcatcttcaaataatctgtatttagacaacacataggtcaaatctcaatataagctctgcttcagtgacaaggaggagccttaccgcagtgaagggaaaaatcacagaaaaaggcactccaattcacaactcttctatacacatctaggggtagttagggattcaagaggaaaaagcaaatcaaccaggtgaaaatggcaacaacaacaaaaaagatcaggtggctgttctgaaaaaaattaaaaggccctttttcctcctctcttacctattttatagattgaccaaaaaaccctcagtttgggttgtacttgggggttttgctcttctcatccagtcctgtgaaggaaattcacattgcacttaactgggtgatcagaatagagcagtgagaaagaaattaataagcctttgcaggctgaccaatgtcctattggggctcaaaagtttgatgggataacttggaaggtccagcaacttaggagagtttgaagacagacagcccccacccccagctatgttttgtatccaaaaagaaatttttgctagctgaattcatcatcatttactttgtcctcagcacagagactgcttgcatatgcaagcttttatttcaaaagggattctcttctgattttggtgtcactttatacatttctgtaacaagaaattctctcggcagctgtacttatgttagaaacacaaatgtaccttattaatgccagttatcaaggcaaagggtttgaaaatacttgctaaacatttgtttatttatatacaatatttcagagttttacacagctaaatactggcatataacaaacactgtgagtgtgtgaaagaaatataaatgattccagcagatggcatggtcagaagcaaagggtttgcaagtgcaagaaatagcacaaatccaaattgagaaatctgaatggctgtaattgtaacacatctacaatggaatcaagaaggtcatttacattacgttaagaaatacagaagcagagtcttatataagcgtgttacacaaaatggagatttggcacatgggttatcattggacagtgtaccacacacagtttttatttcggttccagcagaaaaacaatattgacaaatttctttctctctttgcttcctactttatcgaatagaagaggtaacaatagcatctgctgcagctggctggagcctgagatgaggaaattgtagctgatgggcctcccaagcatatcgacactaaaaagctcatgctacagccacggcacagccaggctagcactccaacgggagcggcagatacacaaggcagccactgtgaaccagagcagggcctgccaagacagcatgtcaagtaatttttagtggcctgaagtggtttccaccatcacagctccaggcactgccgcaaggcaggacaagtttatctatctctgacatcttctccatctccctttggcatcgctctacgattttctgctgcggtagcctcactgaccaaattggtacccagtgcattcagggtgctccctggctacccatcagcctttcttcccattattcatgggcttgaagatctgggatgcttaattgggtctaatgtgtcaaaattacctactccaatcatcttggtgtcaaacataacacttcctctcaatatacaggtgctttctggttattttcctaatgcatctagaaaatgttaagggaccctttaatcaaattgatttgaacaaaattttaaggaccatactgcagtggaaaacatactagacccgcagtctgaagacttgagtccagcagaagcctatgggaaagctgtcaacctcattggcctaattttgttttctcaactcaactctgaaatttaaaaaaaaaattaaaaaaagagaaggctgcaggaggggaagtggtctgagagtctggaaatgtcccttccacggctatgattcactgtgaatgaatcatagtcctgtttctgagttcaaaaagaggcccactagccccagtaaatcttgaattacaggaagatgtaaagaaaatatttttgagttaggatgtaaggagagttaagagcacaagtttctcctacccacaagctaatattttaccagaagtaatcaggtagcagttatgaaatgcatttttgagaatggacttttttcctactttcttacctatttcacatactattcataaaccctgtattttggggtcagcttagggggcttggctcctctcatcgagcctggggagggaaattcacattgtatttagccaggctgatgagcatggagagcagagttccaccaatccagtaaataaggttcagcaatgtggcactcagaggtagaataaatgaggtcataaatgagttgttgttttcccatccaaaggtggagtatgcttccccattccttgaatctggaatggcccctgacttgttttaaaccaaggaatgcagcaaaagcaattgtctcaaaaggccttgtagcttcccctttgatgtcctcagaaccctgagcccactggaccaggatgaaaagccttggggagaaagagagaccccatttggctttcccagcccttcaagctgactgagaaaaagagctcaggagagataggcagaagatccatgtcctgccccaagtcaacccacagacttgcgagaaaaaacaaattactgtggttttaagccacagtgttttgggttggtatttgtaggtagcaatgctaactgacagacataccctccgttctgccaactcctgtggcacacaggtgtaccagaaacagaaatacggttatagtattttaaaatatgattcaatgctcaacaccaaaacaaatgaacaaaaacagagagaaaagaaatattctcaaaataatcataattctcatcatcctctccctttcagacattaaatgaaatttgagcaagagcaagtggctgtttaccattggaatggaagagccacagttaatcctgactcattttatctagttctttttttaatatactagagatatgacaaaccatacactcagcaagcaccactgtgcactggtgaaacacttaactgctgcctctcccttgatgaactgcaatgtagagaagaattttggggggaagtggaagaggtattgagggaggtgagatgggaagagacagaaaaagcaagactgctcatgtcccttggaagaaagtagacaaaaacaaaaaatgaaaaatatttaagtttttcataagcaactcatctttggtaaatttctgtgatttaaaaataagtgtgctgtcccagaaatctgaaccctcaaaaatcaaagggcaaagaatttcaggaacctgcaagcttgaggaggcagtctgacattatgactcactttctttccattcatctcatctgttatctttggcctccattaaacaatgagaaagggacagtcactaagtcatatgccacttgagggcactcctggggcttattgtttggaactgccaaaatgctggacgtcataccaagtgtgaatacgaagcaatgtgactaatatcatagcacaaaagactagcatttatcaactccaaagagcatggcccttaaaactagccactttgagaggacaaagatttaatgcaacgctgccatggtgcaaaaatatttttggaactccttcttggcagtagagttaaacgcctacggcctgttcttttgaatccagtaatggtggcacatctttgtccttgaaagtggatttatttatttatttttctagtgccaagagatacctggagccaagcgtatggtttgtatggttggtgaccaaggtaagaaacactattagatttcttttcaagtaatgagcctagttctctgtatgctttaaaaggttataattaaagtaagtctcacaaagaagttctccaaatatttaaaataagagttgcattcaaataagcattttttttttaagttagaagctttgaggtgggttatcgtttggacccaataattctgccaaaattaaaaattagttttattaccataagcagtggttttcatgtaggggcgattttatatccaaggggacatttggctatgcctaggacatgtttttattgtaacaatgtgggggaagggaggtgagggtggtgagcaaagcccaaggacgctgctaagcatcctataatgtataggacggctctcatagccaaaattctacgatctaaaatgtccaaactgctgaggttaagaaaccctgcttatagaaacaattggttctaataagcaaagcatttattttagtgcaatgatataattataacagtacttaacacatttttccgtgttaaatattccagttgccacccatcttctatgttaatgtatacatgcacatgttttctactcttctgaatcaacaattacgtagaactcaaactcacagtccagaaaatataatagtattctttgtggacattaacagagtcaatttaaataactgtgaggtaaaacaataatttttaaaagtcagtaactgtaaacatttgttgacttctttctatgtaacaggctaatgaatcactttacacggctcttatttaatctttaaaaccaatactatgaaagaaataccactattatccccacgttactgatcaggaaattgagtcttagaaagattgtttaatgtgctcgaggtcacagatgcagtaaatagtacagctaagatttgaactctgtttgttagaacaatttcaattgcagagttttcactaccatacaatgctggcccctaagagcagctctatgtgctaggagccatctcatttgtaggttagggacagttctacccccatttgtaggatacacattgagcaaaatggaaaatggcagtataatatacacatagatcagaaagggggttctccttctgattccgcttactagttaagtacgttttcttcagcaaatcacttaacttctcagggtctcaatttccttagctggcgagtgaggaaagtaataatgcacatctgccactcttatcataaacatcaaataaaataagtgatggggagatgctctgtaaacagtcacttacaacacaaaagtgagttggttgctattcttaggcacgaaatgggaacaggattggtgataggttctcagttgcccttgaaggaaccttcatcaaatagacctgatatatgattttgaagttagatagtattgtattactattggcctcacctctcttccactgcatttatatctattatgcttcttttcaaataaattctgcatttcatcaggcagccagaatgctcttcctagcacctcaacttctccattttgagttttacactttatacctactggggacactatgcaattccttttaatgcttttttttttttttttttggttccattacttttaaactattttggcagaaggaagatatttttctatcataggactgtgccatcaacagactgaagacccagcctcctgtttttaacactatgttgtttcataaactacgcatttgcttcttatacagaattattggtgtatgaaaacagaatctggcataatgggttccacatggcataattatttttccttaccttaaaatgtttccataaataaggacataatttgtacactccacccattcttatcgagatgttggcatttttaacaatcctacctttcatctacagaaggctagcatctcctattccgtaatttacacataaagataaaccccaggtttaaggaaaacatgggtctatggttcacgtttgtcagcatctcaaaactatcacatgctttggcaatacttgtggtctttgatctgaagagacatttgaatggaacattagaagaaataaaaatggaatttagaatgaatggttaaaaatgtattaaacaattttccacagcactcttagcttctttggatcacaaggtcttttgtttttatgctcttatgcaatgctttccaaaatctttcttttgactttgaaaaggccattttcatcactattgggttgggcttaggggtacatggttatgctatgaatatggcctacatagtttcctggttgtgcttccatatgcaaagtcaaaaagtattatgaagattggaacttaggagtttttacaaccccaaactggcatctgattttttactgggccattttagtggcctgttggtgcttctaggaccttattgctctctatgtggtatgcagtccctattccttccagttctgaagagtggtttgattctatgattgtgatagatttaagtgatactcaggaagcttattttattttccttgagactgtttcacttagaagatcaattcaggagttgtgatctatccccttttcaatttttttcataaataaatgtttctcttatgaatagaaagtcttccttttgtcttaaaaagagttaatgtgacataagatttagtatcatgggtcaaggttttataactgattcactgaaattacagctttttcccaatgtattcattctagtatcatgggtcaaggttttataactgattcactgaaattacagctttttcccaatgtattcattcctaacaaatgcaaatacttagagcaaatcagttgtcatgtccctctggtactagaatatagtctttatagaatatgtggtttagaataaagccacaaattattctataaaacaacataaggaacaaggctcaaaagtggaacaaaacggccttagtttctaagtggaagactaagacgatataggaaaatgtaatccatgacctcttaagaaaatctcagtttaataaatagaaagttctgccccaaaatcacattttataaataagataaaaacaatactatatgtctctattcatgcactgcacatatatatatacacacacacacacacacacacacacacacatatatatatatgtgctgtgaagagataatggcaaatatctgacaacctttacacatgtgcagtaaagagctaagtataagggactaggtggtctctgcaatacgaagagtaagaactggatataatgatgggtaaacaggccatggactttgaaatcaggatgaaatgtatatgctgtatgaccttgaacaaatcacttattacctccctgtgcggaatgctctttgcaagcaaaatatactattttctggattaaatgactgctcagtaatacttggaaaacagtaatggctccatgattggtagctattgtgattatttatgttccagtgattaaagaatggaaaagactcacatgctagcaattgcctttgatttagaaagagtgaaagaaaggccagaatatagcaatgtggtatggaatcagaaaggaaggagtggctcattctgaccaggtcaccagggaaggcttgacagagaaatcagagaaatgcccccaaagggacagcagaaaggggagctaaaaaccatcatgggacctaaagtctggagaatctgcctgatttatagggccatgcaacatggggaacataatggccttgccaccactagtagtatgagctcaggcaagcaagctgatcttacctggcctctgctgttttttcttctgtgaaatgggagactaaaattactccttgtaaattaccacgggaagcgaaaagcagtaacacatataaagcacttatgacagggcctcttcagttggcaagaaagattatttgatgttgaataagtgctcaactatcctgaactattagtattgctacaaaatggggagctatgtctaaatttaatcatggaatagatggtatgtgggaaagaacatgaaatgtagagtggtagaaaaaggaactcagaaatagttataagtaaggcaaaggcaatttaaaaagtaagctctcataaagaaataccccaatataaagggaaaaaaatatagtctctaaggtgaaaacacaaaccaaaaaaatcagtccagccttgaaactcttactatttttgtaaaaattactaaaatgccatatgtaattcaacaaacttggacaagcaattattgagtgcttactaaggtgtaagagctgggggtaaaaatgtacataagccatgactcatgccttctgagatctcaaggtacgtatgatctgcacacatatagctaaacttgcacagtgtgaacctattctatgagaatttacagaatatttaattcttcctgtgggaagataaatggggaataagcttaaaatgtttctccagagttacaactcaaatgtctacaagataaagcaatgtcataaatgtgtgtaaaacaatagggagtgggaagggtttgcaaaactggatagtgcattccagcttaaagaaattcatgctcaaattttaaaaaaattatcgtgtatatcaacaaaactatctgaagccagtttgcaacctctgcaatacaaatagaaaatgctatttaagttggattatgcatcaaggttgaacaccatcaggtagagaaggggaattgttgaaattctagaccagataaatatctttggctgagatccagagatgaagatatttggaatgtgtagctatcagaagatggcccaaggagtcaacaatgaggtgcgaagggtgagatcagcctaaattacaaaggggcatgaatgcaatgataagcagttcacacctcatcttgaaggcatcaaggacaatggcattaagttcctttaacagcatcattttaagagttgaaaggtttctcaggtctttatacaaacagatgtattattataaatgatcctctctaacacatagcatcaacatgttctctctcactgagaaaagtctcatgggattgccatagtagaaaatatgtacatttgaaaaaatccattcatttaatgatttggatgtttataaacatctgttatttaataaaatggatggctcaggttacgtagatgatatccaaattcatgttgaatttttcttctcagagttctaaatatacacacagcttttaaaaggtactcagtaatgaataattattaataatttaaaattactgcatacttctatatgccatgcactgtctcaagtgctttatatgtatctattttatgtcatcttacttaatttttataaaattctcattgctatagcgttatcccattttacaggtgaagaaacagagattaaataatttgtccaaaggcatacagccagtaagtaaacaagctgacattttacttaggcagtctatctctccagagtgtgtactctcaatgttgagattctatgctctgtatgaactgatagataactagagttggcctttccttgcttgcctgtttgaactagaccttctttcttttagaaatctggtagactctgtcctccttgaccttccaaggccttgtctgcgcttgttgcactaggctatccctaaaattcttttttgttgttgattgttagaatttcttttacttaatggctcatttttgtcttagtccaattacagcacagaatcattggaggaccataatttcctttttctgtactgcaccgccagcctgaccttttttgggctactacctgacttctttgaaacctcctccattctcacaggatatattgggcagaaggcttggatctactttgtcactacttctttaatatagaaaaaaagtttagtacataataaaagaaatcacaacacaaaatacagtattcaccttccagactattttttgtgattatgtgtaacatgatcatgattaaccgtgatcagtatccctttgtaacatggctattgtggctttttgcatagtttctttctgctcagaaatggtttctaaactagcatttctgggatgctacacggataactgtcatttaagaatgactttaatctgctgctttgtcacaaaacattatactgtcaagttttaacttggcttgtattcaactcaaggattcaagataacatggatgttgacgatgttgacatgaccctcctaaataaagaggccaaaacttcttaccagacatgtaaaattacctatgggtaattatttcacagagctcagtttatgcagttcctttccctcattgtttcgaagttgctaacaaatttcttccaccaatatacctactcttctgttgtttgtttcaataagcagcttctccagagcctcaggcacagcacttccaaatgtcagcagctattagctcagcacattcatctttgtttccttatttctcctgagtagcctgtctctctcagaggtgagtccaggtggcttaacataacatggatgcgggtgtgtgtgtgtgtgtgtgtgtgtgtgtgtgtgtgtgtgtgtgtattttctcaaaataaggcattacagctatttaatcttatctctcatatttgctatttgcttgcaaacatttttgtatctgtcacggtgcctagcatgaaacccataccttgcttataatctacagagggtgaaatgcattttaaaaattatgtatgtatgtatgtatgtatgtatgtatgtatgtatgtatgtgtatgtgtctgtctgtctatctatctatctatctatctatctatctatctatctatctatctatctacctacctacctatctcagttttctagtgcctccactttaatttacggaaatgggaagaacatttggagaaagcacagattctgtattttgaaatgcaatgtgaaaaaaatcatcatgctgtttttcagtgaaaactcccaaattatgtgtctctaatttttgttcccattattttaaacatataattacacacgtgtctgtgtgtgtgtgtgtgtgtgtgtgtgtgtgtgtgtgtgtaccgtatttttgccattaggcatataagggcaacatttcttctgctagaccaaattttctgtttctctatcctttggccaaactctatctgaaaacaattcatgtgtttcatgtgtgatttttataatcaaggtcagatctgaccaagcagaggcaccatataatcaggtacattggctctttgaggcctgcaaagaactgtgagcatacagactgatcaaactagcacctgaattaaaaccaaaaggcaggagaaccagaagtctactttcatgatgtaaaaccacttgctcaaattaaaaataatttttaatgttttacaatcatgcagaaaactgcaactggagtggccagtcctcaaaggaccctgtcttggatgtagggaaacaagaatctagataagacttgaggccgattacgccatcaccttcttagttatcagtacttgaagcaaactttgtagcctctcacttctcttgacacgacataattctcttaacccaacatactgttgttatgaacatcaaacaaaataaagcataggggagtgctttgaaattagtaaaatactctccataaatacaaggtaatgttattactagtttttatctaggaaaacatttgctggaaaagagaaactttatcctgtttggaacttgccagctcattgtttaacaatgagcattgtagcatggtttggctaggtgaatttcactgcttttattctgatcagcccgttgaccccatttctaaaaaactagctccttttctagggtctactgtattatatttatattatagtataatatggggtatgaaagagagtgatggtattaagtcacgatagaagtgatttacgatagatgctttcttgggtttttcctatactcccagacttctattttacttatctgtggaagaagcaatattttctcatatttgaatttctcaggttataaagaactatcatgaaattatatgcactatacatttatatagtaataaatagactctgaccagatagcttgagtagtctgctaataatgatacttaagaggcactcaaacaactggaagaaatcagcttaatatttaaaaatctataaacatttatatatatcgcaatctgagtggtgatgtagctgttagagttaagcaaaaaatacaaactatacatttcgagagaaatacaacttattacctttgagtacataaaacgacttcttccaaattatagaacttgtatatattctattaaatacatttttaaaaatcaaattagtgatttgtcatgagacttgatattactaatgtacagaaggcatctttaagcaataagatagtctccctaaagcttgtatgatatattattattttgttcagtaatttttttcccctataaatagtaaaaaggttgtatcagtccagcccacaagaacttgtcaaacaatacaaatttgtttttaagaatattcccccacatattattttttgttttacatatttatagccatgtgcccacttaattttgtgtttatttatttctcttcactgggaaaagacaatagcagtggaccatagctacctactatctccaggggaaatatgcatctatgtcaaatccatcctattgatgttagcataggcctcatttgaccaaaagagagctgtattatttatgaagacatttactattccagaatgtcaagaagttgcagaaacatccaatgagagtcaatttagctttctgtttcctgactgcaagtgaacaaacgcttcttacctgcagtgcacaaccatcggaccagcatcgggagggttacaggttttgactctacgtaagaaagctagaaaaggtgtagggtgttctggaacaccatgatcaggccaggcggtgaactggaattgtctcacttctctcttctcacttgaaccattctgtgaaataggaatatcagctgaaattctgttttccaagcctcaggtggtaatgatgaataacagggaagaggtaatgctaaaatgtgctattttaattcctttctaccaccctgtagcctttgggaagacacactctttggaaatagaaaccccaagctatttgtaaatgacaaatatttgcgcaggaagacaaaattcttaggtgagaagcattatatttttcaggtttaactaccaggagagctcctatcacattttacaggaagagctagttcttcttcatctactcttcattggctgaaactttcatttggagcaagagttttatatttactgataaatcgccagacaagaagaaaaatggctgagtgataatggaagatctatttcattcttcactgttgccattgagatcaagatttaagtaaagccttaagagatttcatttctcaaaagaagctttctttaaacaatagagaagggaaagggaggagaaaaagatgaaaagcaaaccttgtaaagtgcaaatgttcgaacacaatatgtggccagctccacagtatcaagcagcgttacttgaacgagtccgtgggtttctgtgcctctgctaggccaatactggtcacacttcacctacaagaaacaagtgacacattcagggcaaatgctcatcaatttctctattaactttgctttgagttgctgttgaaggaaaacagcttttctgcacttcattttatgttgatctttttctggcatgcatttttgttatcccaatatatgtaaattactgctctgatgccaatataaaccacatttttcaaactggtaggaatactaaacagtaacagattcaattttcctggagaaaaataagttgcagattgttgctgggtaaaatacagagagagggatttgaaacttcagtgagcttgaagagaaaacaaatttgtcctgggatagacgttatgaatcacatcgggaggatgacactttgtcatttaaactacatggtaagatagtgttacttcatcaagatttaaaaagcacaacttccaaatatgcttgtttaaagaaaagtagaaataattggaaaatctatcaaagtataataaacaacataagcatgtgctttttttttgaacacaagataaatgttatttgtatccaaagcaaattaaacctataatgtctgcaggaaaaagagttgtctgttccttaaaaagagtctcagagggtcacacactaacagtgcaaagtttaaataatttaaaattcatccaagatgaataatctacaatttctatgtgaagtggaacaaaagcacataaaaagttttcagcctaattagtttaacacacaacaaagaataattccaagtctgcagtaaacctcaaattcactgaatgagtctgttgggcattaaaaagtataatgaaaagtaacaaacacagcacaatatttttggagtaaggccatagatctgactatatttaccctttctatctcagacttttttttaatgggactaattcttaagagaacccaactgaaatacatttctctaggtaaagaaagctcctagcagtattttacaatagggaatacacctttctatttgaaaaagaacagaaaatcacaatctttggatttaaacaaaggcaataaagcattattattagagacactagaattttttgggtccagcaaatagaattattacataatgatttgcttttatgtttaatatgagtatttgtaacattctgtgaataatactgtaattttctctttcacagagatagcatttgctcctctgagaattcaggctctttccatgaaactattggcccttctaagaaagggagaagttttatcctgtacagaatttcccagacaagacaaaaaagaaaagcactttatagctatacagtaagctagatattaaattcacaaggtttgattcctatgccttgatttcaactttgagaccacacaaacatcatctttttgatgaaaacaaacaaaaattgtccacagtaagacaaaaattttgccttaataagatgtaaagaatattttgtgtgtttcctagttgtacaaaatagccttctgtgttttttatttctatcatttgccctgactcaaagagataacaacatagggaaatgataattcttgaaggagaatactgacgtagagtgaccaggcatgggcatctctatatgttctttcaccataagctaaaacccaggtcacagatgacatatttagcaaaagctaccatctgaatagaaccaacactacttcagcagtcatgatatagatgagaaaaaaaaaattaacaaaaattatgccaaaggctttgttttaaaccatgaaatagatgtcaggtggatgtctcccagcagaggacaagaggaactctggaggcctcatattgtaatattcaagaagatgccaacaatgggttgagttgaagattcaagagagaaactcaaattcatcatttaacagtctcagctggagagcaaccctttcggtttaaaataaactaatgaaatccctaaggacaaatatcactatgatatgcacaaaaacagcacattaatgcaacaaaatgatctatacagccagttcaatgcactgaaccaaattcaatataattatattttaaaactgggactcgattacatttagaccttctagtgaggtaagaaaaggagatgaaggaaagaatgagaaggcaaccttcatacaacttttggaaaaatgactctccatctacaaatcttctccattcctaagatgcaggaagaactaaaattatactaatccttacatttctagtaataagtttcaaactgcaactattattggcttagactctgacccctttagaaaaaaaataccaggaagcattactgtaaggagtaaacgctgtgaaaatttctagctaaaagaagaaaaaagttgcttttgaacaatgcatttttagtatttaccaaaagaaaaataaacatttcaaactcaactgcaaaaatcagaggcaattttttaaagcggatatgtctaaatattaccattttctctcaggaaatatttctcaaaaggaccttatgaaaaataaatatcctaacgtatgtggaaatgcacacacatggcctcagcagtgggattagaagcttttcctgagcttatctgaatagtgacagcaatacatttttccctttgctggtaagcacctcagtacttcctttctcgatctcattctctgagtagcctgcacaccttcatctgattttggagggctgaatttaagggcttagagttactgacaaatattattttaagtctccttttttgccatatgctaaacatatgatttctgatttcagcattagggagcaagtatgaaatgtagtgagaaagaaaaaggagaacaatagagatattttttctttcctcattagccagtataaatgaactatctccattttcctctcttaaaatgttttcctttgacaactttccttcccctactcggtcttcttaagagaaaatatcataaggtatttctagagagagttactatttgttaggcttcacacataaagctgattgtgagatgagaaatgaaggcagctccctttgagtacataagaactagaaggcaggagctactgaatacgaatacggttttttgcctttttctatttgatttagaatggatacaagcggcctctaggactgattcatggaaggtcaggcagagtctccctggatgcctggaaaattgtttctctgtttccaggaccaaagtctggccgcctcatctgtgaaatgggaacagtgtctccagcattacagagctattgtggggattgaagtgatgcccctaaaacacttaacccaaatggctggcacaaacaggcattcaacaaacactagctatcattggttatcagtttgatgacattctggatttttgtgtgtggggggttgttgttataaattacctaaatcagtctaaatgtgaaaaaaaagaacatgttattaatttcagcagatactgatttaggattttctaggtgcaaagcaaggtgttagcagttgtggggcatcaaggtgacataagacccagtccctgccctcaatccattagccttactgactaagtggggtgtttctaaacctccttgttcttcaaataggtggttctgagattccaaacaattctcttcatctatgtgggccccaatgtcttctgaaaagagtatgtgttcaactcagaggtggaaaagaagaacagcagaacttgtcactcaggctgtggtttagaaacatcacccagtaactttacttgaagcttaaactgagacagttcagatttttggctaaatttgcgggaggcatttcttttcattatcacaaagttattacccttaagtggagctttcatttttctataattacggaaagaacagggtgaccattgctaaatttatgcaatggaattaatttattttacctttttcatgacaaactatcaaaatcaagttgatggaataataaaacatatttaaatttatttttaaaactcttgtcattgcaaatatctggtaggagctgatccattaggtctgctgaacatgctttgggagaagggctctcgttctaggctatttttactcccatatggcttaccttgggagtgctcagcatattgtaggcacttaatgagcggtagccaactttataatcaattaactagattggcttatttttaaattgtctaccactttctgaaaacaaaacctcctcatctcaatttaataaagacttactgagcatggcaacatggcaaggcatcagaattccaactgtaacaaactgataccttgaaagggttctagcattgctaatccaaaacgtatttgccacgagattatttagccaaagaaggacttagaagaggcaataaatgatacgtgggataccataactattgctaaaagtgactctaaattcgtacctagtaagtttgggcagagtggttgttcaagcattagtatcctgtaaggaatggacaaacaggctaacattagataacacaagtcacagttatttttgggagtaaggaaatgttggtacccttttgtcaatacccatttaatgagggagactataataaaggaaagttttagataaatttcattaattttagtgggcagaaaaaataaatgctgaactatttatttctacaggttatagtaactattctggaaatttttaagaccagattgaatacttgattttccacgataaggacagagagcatctcagtgattctcttttaacaacagtgtagttctctgcactcaatcaatatttggctatatctattcccaactggcagtcagtctggtttgtgtattcccccattttattatatctttactaatcactatttagtggaggacaaagaggcactacaatatttgaaatgagagtgatattaaagcatttgaccaccagtgcagcttttcatatatacagccataaagttgaaaaatattattctcaaaataaaccaaattacatgtcataaaattgcctaccagttcattgaaccattcgcacactttctaaactgcttattaactttaaaaaagttattcccttttgtttgatgtgtctgccagaagttgacatagggagctgccgtaaacttttccaatgacttcccccattaaactgaaagtcattaagtctcaagtttctggcactttgtcctaaccagagcagaactgtgtgaggtgcctctttctcgtggccaagtagcactttgatatcagctcttcccacatgaggtgggtcctcagagtatccacctcagacctaatcactcctgaggatcacctgggtgccccacatagccctacagccacctctgcttctgccttggtctgcccagcagttgcctttgactccagtgtcacctcttccaaacagtatcattagatgactcaatgtttcaataaaaatataatttataggtaccagccagcatcaatgcagttcaatattttaacaaccagtacaactatgttgggtatttaccagttgaacatcagcctttccagacattctgctgataaagaacagagaaaaaccaaacattggaccctaaacactagtaaacagagattaacacatacttctgaaaactttagaaatgagacctaatccagcacaggagaaccacagacatgaatgcagagaatgagagaggctttgtacaaagtcatcaggagcaaagttgcatctcctcctcccattccagctctttactcaggtcatcaggactctaactggctttaagaggaatgctttgagccagaatctgtcagctgcctttctaagtagagcaggtggggtggggaaagaaggtagataatccagaaagctaacaaacagcaagaaattggtgggattctttctcttttatctgacgctgtgtctgctgacaagagaaaaccaaaagtgtagaactttctagataaggaccccaacatcctttagattgccaacatgagcatcattctttttgttgccagcgtcctatttacattaagtatccaccactttcaaaaacaatcccatacatcatgcagactccaaaggcaatgtttgtgctgctggtcctaaagttgcttaaggaaaaaagcagtttctgttgccctagataggcagcactttaggctgcagtttgagaaattaaatgttcacggcctttggcgcttccagttccatttggaaaaggacacaaacctggcatttggaaagcatttgctctccattaaacttaccgaaccttgacaaaccagaagggccaagaattagtctgccactggccaaggctggactttccaaaactgataacagcaatgaaaacaatagcactgccatttataatcttcaatgggattctgtcaaattttaacccaaaaggatctcacaatctgaaaagaatctcaagctttgttttataggaaaagaagaaaatgtttgagcacaatctctttttctactgcttcatgctcagaattgcccttttagccatagaacaaaatgtgaatgtctccacctcaccttcactttgtgctagggtaagtttactaaggtgacattcaaggactggggaagacataggaggaggagtgagtggtcattaggtcagaagtgttccaccagccaaatgtcaagttccctaaactgttaacaaagtgaagttaacaccagcccagtctctttggccctgacagcatctaacctgcattcattagcacaaaccacaaaatttagtagggcaggaattttcccattctttggcctaagatagaactcaagtcacgatgcacaaaacatttgatctgctttactaatatatggcatcatctggtttgtatgattccctatttggaaacagaaaatgggacttaagatagcttggaaaccaagaattaggattcttcatttctagccctatattttcactactaattggcacagcccacattggattacaataaaaatcatgactgatttgttaagtgtcaaaatttcactccccatctccaacatttataacgctaagtacatttacaaacagctctttaagtgaatcaacccccactataaagcttgcaagacaagataaacattgagtctctactatgggcaaggaatgaaggcaagctggtgaggtgaagtaaaagtcagatatattctaaccctgactaagcctttcaactgctaatactaatcagggttactcaagaattttctaagcatgaggttgatgcattctctctgtgttctgtatttcaagatgggagacagagtaggagagaaacagtcaagagaagatagatgaagggaaaaaggtgaacactcacacactaaataataatttaatatacacttacttaaaaaagcagatgaatcctacctcggagatgccaattctgcaagcaaggctgccaatcatgtgccccagtcatcaaaaataatatccttggagtggaaatcccagctgtatacattttactttccctacaaaatgcttcattttttccaaacagtttcctccttccatgtggttgcccagaccaattcgtgtgcttattggcatgttatgaaacatggaaacaattagaaaccacattctagggaactagaatgacttgctacagaatcaatgaactacgcaaaacttgagaggatttggcaataaagatggaaactagggaaaaaaaaccactaacagtatttcatattacacagtacattctacaacagctttaaactgatctgtgtgtttcagcagaactcatgctttcccttcaaaatctccagcttctatcattgtttttttgtttttgttttgagatggagtttcactcttgttgcccaggctggagtacaatggtgcaatcttggcccaccacaacctctgtctcccgggtcaagcgattctcctgcctccgcctcctgagtagctgggattacaggcgtgtgccattatacctggccaattttgtatttttagtagagatggggtttttccttgttggtcacgctggtctcgaactcctgacctcaggtgatctgcccgccttggcctctcaaaacgctgagattacaggcgtgagccaccgcacctggcccgttgtctttgtatttctttatataccctaatgaaactcatatgaaatattcaacttatacttttccttcagggttgatagctgaatgtatacaccaggcaaagagtcttctcagttaagattggaattctttaaaggccacatttgaagggaagtaatagcatttgaaaatcaaagaactcatgttttcaaataatcaacttaagtcctaagtcatagttcacacttataagggtttctttagccatgcaaacactaagaatgatcagttctcaaaacagatgctagtgaaacttctaatacctgctaaggaatccagaagccttttgtctcagtgagctgttctaactcaccaaaggtattaatacaagcgctgttgataaacctcagacctgagcgacagcttaagagtgagccagccaggcacgggctggctcaagcctgcagtccaaacactttggggggccaaggtggaaggactgcttcaggccaggagtttgagaccagcctgggcaaaaaagtgagactctgtctctacaaaatctaaaaattagctgggggtgggtgctgtgcacctgtagtccctgctgttcaggcaggattgcttgagcccagaaatgttagattacagtgaactatgaccacaccactgcactgcagcctggacaacagagtaagactctgtctctaaaagaaaaacaaaaacgagtgaaccaggctgtggcaaaacagaacgcttgaaaagagagatgggctctaaggcaggacaatttcgtagcaccataaaataaccaaaaaaggggagaggggatgtaaaactgaacaataaggaaacgtatcttcagtggcacttatcactacatgtaacccatgtctatatcacttatgattttcatgttgtattatagtcaatgtagcagccggaatgttctattttggtctgttccccggctgatctctattctggagatcctgtcctgggggagagcaagtaggaaagaatcccatggtctgagctcctctctcctcttgaataaaatgcatgggtgtgccacactgggaaacgtgggcataattaaccatgttcagggacatggagaggttggtcaggattcatcgtcaaccatagagaaataaactcttttcatttgggaacacagagtgaattatttggaggctatcttttggggaaactgaagttgtcactgtaaagcccccaacttctttaccaaacaataccatttgagactcactgagccaccttgccacatcctttatctcagtcaatacccacaataacccttccgcataatccaaaaaaggaaaaatgagaatttgaggagtcaagtaaacttgctcattgtcacacagctagtagaggctagagttggtatttgaactcagacatctgactgcaaagtgccctacttggaactgtcccatagctgtcctctctcatggtggtatccccatgcagtcctgcgtaatatcaagctatcttctcttctctttccttttctcccctcttccctgctgcaaatctatggtcagtggcagtctagcatacttctaattcacagcagcatttacaagacgcacacatattttcttcatgtaccataggaatgaatattattttaagaacctgagccttaatctaaataatgacatttcaagcttcagctcttggagaggtaatttgtttacgttacctggactacctccctttatgaggaagactggtgccacttcccttcatagggccaggctagttccaatgtctgctttgaagttggctgctgggaattgaaaattcactgagtcccaaggtcagcccacagaacccaccacgttcctgaagtctggagctatagatttcactaacaactcacccctagttataacattgtttttatagtgaaagccaattccagctcttgtttgggaatccaggaatgccttctcctttcttcccgctactttaggtaaaagagcaactggatagggaaagggtgagatgggaatgatgggagggaggaagacggaagagcagatgaaataatatgaggctccagtgctttgttaaatctctccaggacatgtggtcatttagtcccaagtgttctggactggagaacaaaggacttttgggccttggggtccagggctcatgtgtattgtcagattggtggtggctgagactccccaaatgcctattggcttatgcaggtcatcacaaatctgggtacaggctgaaccaccacagaataaaaatcacaagacagcattttaattggcttccttaggccatttaacaaaggagaaagctaacttgcaagagcaaagagtaattaatgaagggagcaaacagaggttcatttagtaacttccaaataagttcctctggctgaggggagttgggggagaaggtagcctgcaacagaaagataaactgtaggtatttaagtcacaatgccttccgccaagaactgctcattaccatcagatgttgcagtggcagtggggccagttagaactaactttattattagaagcaattagggagaaaaggggcagaatttcatttggttatttcaaaacaagtttctgtgcacagtttaatgaaggcctgcagtgtcaagataaaatgtgtgttttactgaaaacagcttttgcaaatgactgcttgttaccagcagttatctccaggcagaacagactgggtaggttggatttacatgcatgccgtaatataatagttcagctgtctcagtttcacagaagtgtcaacaggcagtatggcttgatggtgaagcacgtgtgttctggagccagactgtctgtcttcaattcctatccctgaccttggtagctgaatgaccttgggcaaagcttctgtaatgttctgggccccagtatactcatatgtaaactggaggtcacagtagtgtttcttgtaaagggctgttatgaaatatcaatgcacctaatatgttagacattattatagttatgaactattatatccaagatcacttgggaggggagttgtttttaaagaaactgcttgatatataggagttaccttaagtacaaatcagtaacaaatccatttacatcttttgaattgggtttgcatgtaaagtatggcagatatttgtcttcagtgtcatttttatcttaattcccattttagacaatatttcaacatctctatacaattcagatgttttgaaaagatctaattgctttttagttttgctaaaccaaccatttatcactgcttttgatttcccacctttgaggttacagttgtggctttttaatatgtttctgtctgagcttttcccttataaatctcttgggcagcttttaaattgtccctcatatacacgcccaggcttagagaaacttccatgtgttgagcttagaagaacatttacagaacctcaactttcacacagtaaatggggaatcaggctttcttccttctaaatatcctttttgagactactataaccacagtaaaagaggcctctcacttgtggtttcaaattctgtcttgaatgtccctattcttcaatgaaagtatctgctgtcttcaatgaagtttcagagatcccatcattaatttctcaaggttaaaggttgattttcttcagatgctacaaaatgtacacatgtactcaggaatatggtatactgcttacccattattttttagtccttcaaaccaacagcatttaactaatgtgccatgcaccataatattggacccatacgatgaataaaactcttttcttggaccttaccaagctatgactccattattaaaatctactcattttggagaagtttaaactagcaaaacgccctctatgcatttatgttttctcagccgtgtattcagccacatcatttttccagctgccctgacttaatttatactaatgtgaataatttaagcaaaagcctctttcacagaacttaagtcttatgctgcagattttaagaaagaaaaagttgaaaatagtggaagtacatattggtgggattctccccaaagcccgtaggttcttgttcaatggtgtttttgaaagaggttcaagcaaatatttattttctctaatcaagttgtctattcctgtgaatattccttttttttttttttttttttactttttagcaaccacacacatcataacatgggagaatttcttttgtgaaaacacccagaggagttttaaagaatggtttaattagagttgttgatgcccattcataattagtatctgttagaaagataagccttagggaaaggttagattctgaacagaataaaatatgcaacatagggactctgagggaaaatttttaaaaggaaagaggtggatacttattcttacccttgatctttcttctagttttgtcatcatgacaactgtggcactccgttgttcccatatcattctccaaaagtccccaaatgtttcggggagagatccctgtgttgcaatataggcattttgcttcctatacccatctatgtagttggcattcacatagtcacttcctgggatccctggaaaacaaggagtgttattcaaccaggtgagcacatcacaagaggaaacagcctgggacatgacctaatggcagtgctatcttactgttccacctcacactagagaagtcacaatatattgaaggtcgggtttcaagcaagattaaaaacaggtcctattagaaccgtcatgttaaaaaaaagtatgcaaaaaagtgtcaggtctttataatacgacaaagaaaaaatacaatagatggtccatagaatgccttttccttcactggttgttggttttctctgttgcactggcaaaaaaaatagtttccaaagaacaataaacaatctggtaacattcctcacccatgtgcttcccaggcaaaaactagataaaagaatgcctgagtctgaaaatacaaaatagagtggaacacaccataataatgaaaaattctttgtagatttagttaacaggaaactcatatataaactcatttaatatttacaacaactctgcagtaagtcctgttatgagtcctgtcaggagaaaactgaggtgcaaagaagttaaagaaacttgagcaagttgctcaagttggtggaatcaggtttaatcctaggctactcgtatgtgtcttgacctctgtaaagtattgcttctcatttaaaactcgtgatttgttgtaagcagcacatgaacctcctggattaggacagctgccccctaattggatgtccatcttctacttttgtcctctccagtttgttctccatctaacatgagagcagttttaagaaatttatttcagacactgtaacttcttcaaacccaacaatggcttccccttatacttcaaataaaatccaaactctgaacatcgcttacaaagctctgcaacttcccaaactcatctcattccactcacctccttgcctttaaaactctagacactggtctgcttcaattattagaaaacatttatttccctccttagctcaatccacatcctagaatatactctgtctccttcccatcataaaacacccagccgccatcccagaaggcctgccctggagtaccctgagacatcagaactcccttgacagccctttatactactgattaaggttgtaattatatatttacttgtctgttaagttgctttattgcctattttgaccatgtctcttttattcacctttgctaccctaatgacaaaagagtaaataattttccccagttccaacatgtaatcagtagcagagatgtaatttaatgtagatattgtgatttaaagcctagttttccatcagcacatgcctttaagagagacagaggcaaatttgagcttcttccaagaagaggagccacagtgattaagggaatgaaagctactccataagagaaagaatgcatattatagcctagcaaaggaaatggtaggaattgggataagagctgcctgtgagaagaagagaggtttagatttactctgttgagttccaagttttaaattctgaaagatttaactacagaaacatgaatttcatctcaaatacaataaagcattttcaaatggtcagaatcaaaaagggagttaagtttccttggaaggtcatgagttggctatctgtaggggagaacaagcactttataggaatgtcagcatgatatgggaaggtacactagaacttgtgcatgatcccttctaccctgggaaatatgaatcttggaattacggggtaaccattttttttttctttataatgaaacatatgttcccaagctcaaattgttatatttcactgattgccacttgcaatgactttgactgcttttctgattccggttgtaaagttgatcctctcaagaaaggtaatgaaaatcagatggaaactactgcactctgagatgaacacacggatatggaataccaccagcattagttgaaaagccttttgagcaaaacttgaaatgcatggttggctgtaacattattcatctattacagctactcaagaagcagttggggttttggcagctctttgttgataaagatcctattcctccccaacaccagattactgtagattcaaatgacggtttaaataaaattctcaggttacaaacactgggacgtgcacacatcttacatatccataggatttggttctgagtcaagaatgaatccatctaacaggaaaaacctactttcaaaactttaatttagcagttagcaacattaaagaattgataaaaaggattctggctaagggcctcactcagctgccaatatacagaaaacttttttctaagaaaactcagaatggagaaatctgggctaaatgactcagaagattcatcacctgggccctgtgccacctccccccttatcaaggaaagcaaatgtgtctgaacaatgcatctgaggatggaggagatgcacaggagaatcattcctaaagacagggaatcagacccatccaaccctctttgggtaaaaatgttaatcagttattatgtaatgaattggggttttttgcatactgcccaagtttgaataataaattctttttgtttaacaaggagggggtaggctgctactgaataatgattgcacttcccaggataagaatacaaaaatgttgcctgaagactactaggcaccaggaatcaatactatcactaaatgctttaagaatttaggaattgggcaaagtgtagtaattcatgcctataatcccaacattttgagaggctgaggcaggaggatcacttgagcccaggagtctgagccagtctgagcaacatggtgagaccctgtctctacaaaaaaataaaaataaaaaattaggctggcatggtggctcatgcctgtaattccgacactttggggaggctgaggcaggaagatttattgagaatagcacatgacaagtctgggcaacatggcaaagagaccctgtctctacaaaacactaaaaacttggctggatatggtcatgcacgcctgtagtcccagctacctgggagcctgaggtaggaggatcatttgagtccaggaagtcaaggctgcagtgagccataattgcaccaccacacttcattcctgggcgacagagcaagactctgtctcaataaaagataaataattaatattctgaaaaatacgtaattgaaaacaaaatggaatacctggtagagcaaattattaagccaatgctttatgtcctgaaaataatgctaagattcctcttatagtttgatacctatttgtaagaaggtagtacatggaatgaaagcctccttctggcaaatctctttacgcgctctggtgaaaagacatttcaggtaagttctctctcacagatcctctgcaaatgtggagataagagagatggctatgttctccagaagctctaagatctaatgagtcctgtattcataaaacccaatataacacactgtgcagaaagatgaaggagaaaaaattttagaaaggatggtggtgtgtcctaaaaatattaaccccagattggaagctaaagttaatcagcagtccatttcaagtagatgagactctggtttttaatgtgacatatttagaaagacttttcaaccaacactgtgaaaataaacaatatgctgctttccaaatgttttggtgccatgaaatgcttcttcagtagttcttgattaggatgtttctgctgggaggctggatctaacattcttccactttttggggggtgactttctctaagtagtgcatatttatttaattttcaattccctgccttttccaaaaaatgatttgcttctgctaatgcaacattaatcagagtgcacttctaatccaagagaagtgtgtgagaattaacttaattcctttggggttatgaaggatggaaatgtaacttgaaatgtagtactgaaagagtatagaattactataaattaggtgattgcttttcattcttggagtcaaggagaccttcctccaatactagaataacagtgcttgatttgttttttgggtttcctgtttgtttgttttttggttggcgaaggagctattaaaacaggaggaacatgacaaagatgtttgccttctgctcctcataagcaaaattttagaacacattggccctgctgcaggaactctcttggagtcagttggtcttagtgtctttgttcaagaacagcttacctctaagactggttctttcctaggagtccatggctctactgcatttataaaactgagtgggttttcatgatttctcatgcattgtttcatgtgcattctctaattaataacagtgatgtcaatagttgtaaccccataaataattgtttagccttctaatcttacacatgagaaacctaaggctagaccctctaacttcatattataccaatatgctccattcctgggttaaagtgtatttcctcagttaatgaactgttctttcttgtggcatttaaaaatattacttacatgctttatactgggtctttgtgttctgggctaactaaacctggctgttaatgcaagcctgtaaagccgacagagattgtgatgaggtgaatgattggtagagctgtgcttctgttgtttttcatgcacaacaagccatagcaaacagctatttgaacagaattaggcacgttttaggctctcattttatttgctgttgattgctagttacagttttcagtggaaaaatgagcctggatacagactttgaataatggggtcatgtggattttttaaaaccaccaagaagaaaaaaaaaagcaaacaaacacccaacttgctatggatttgatttttggggccagaagataattcgatttgaaaagatgtctcttgttgaaggggtgtttacaatgatgaggggtttataataaagccttaagtcctgatattaagtgaaaaagcaggatgcaaaataatacatgaattattttgtgaaatcaagtaatcctaaggggaaggatcataattttgcatcacattacactgtaggtaaagtcacgtgtgcattttaaagtcttgggacaatagcaagcacttgctaagaatttagagaaactgaccaggaaacctggactcctgtctagggctgctggtagtttactctgtgatctttggccagttactcaacttgcccagaactgtaattgtttatttgctaaacaagatgtgttggacaaactgatgccctccagttcttttgagttctaaaataaggtgtctgtctgtgctattcttaaccttcttggactcagacatctctgtgaagttattttaagataaatagaggctttgtgtctctcagattaggtaggaacgcactctgatgctctttcaagctgattcctattgcttctacctttgatgtgctgagatgagatttttcactgaggctgctacttcacatcttgattggaacctgatggggcaaaaaataaacaaaaagcaagaggaagtagtggtactaggtggtctgtccatggaaagaagctctccttggactttagcgggtgataataactaagaggcagtcttggagggaaggcagaatcccaccgtggctccagtggatgcggctgcactacagagatggagatggatgttcagctgagcgtcttaccctgctccaactcacaatttggcttcaaatcccaggtacttttattttctttaagttctataaatccctaatgaagtaaggactgtgtcaaaaagaaattgctttttggcaaacaagtttgttctttgttgtaagacagaagtactcaagacccgacagagcacaaaagctacctttcatttgttaatgtcccctcctctactccaacgcacaaacgaaaaagcataacactatattgctgttaatataggttaagacctagattgcaattttacaacaatgtggcaaaaatgtttactttgcagtctccagaaaaactagaaaacaggaaataggaaagcaaaatctaataaacatttacaagcaaattgattaaattctaaaggacacaggcctttcccccgacccttcacctgttcaatgacagccacacgtggctgcatcagacctggtgacatgaaggattctttctgcaacataccaaataaagcaaacatttattgcaaagacacagtctattgtttgccagggtatcccctggtatagctgcagtctttccaagtttctacaaaacacatagaatttttttttttaaaagcatgcctgttctgtgggcatcgtagctcaaccccacagtgagctaatggagaaacagatgatattcagagtatttgaacccaacctgcaactcctcattaatgtatgtcttcctctacttgattttccatacccccacactgctgaggaggctgagttttgagaatggacacaggaaagtagacggctgattgaactatctttgaatacattgcaagatcagcaacatgagttggggaattaccagcacctgtgatagaggggcgtgctttttggttagacagcaacttgccttaaaatacagtagaccttaggccactgaagcttaactttcagccacatcatggagttgtggtccaattagctttatactaataaggaggcaattattatagaggttcatcaagcaatgaagtagtcaacaatcaagcatgagacatgactacagaagctctatgtgtaggaaacactcagatgctcagtctcctcatcactaatatgaatatcataatcaaaaagtcctggaaccaacacctctgtgagaattaaatgaatcaatacatctgaaatttccaaaatgtcatatggattttagttactattatgattgacgtaaaaatggaaaaagtctgcttattcttaatgccctcctgataaaaagtaattccaaatctggaaggcccctttctagcttctactttaagaaaaactatcagacaggataaaaataattcttttacaatttcccagcaatctgctacctgtatctatattctaaaaacagaaccatagatgatgtaggtttatctacggcctcagagtaatgaagtgtagattcattagagtaagctgcatagatgtacaattaaaaaaaacaaaaaagctccaatgaactgaagacaatagagataaaaataaactcactcccagagctttctgattttactcttcgattagctttctgagaacaagagtaaagcaaaaaacaacacagccagccagcccttaaaaatgctttttctcttttccgggtaagaaacatcagcaggtatagtctaaggtaggagctagggaataacagatataacagcacttgcttggctacatgtaagagaaagatgccatttacacagctctaattagacagctcttagaaagactgcaagcaacctgtgaaactgctccaggtttcccaggctaagtgctatctacctttctatttaaaagaaattaagctataaaaatttgtctattcactgctactcaaaaaaaggaagtgcttttatgtatttttttaaaaagtaccacgaaataaaatgattaaacttcatcacagttgcaaacgattaacttgaaaatagaaaaactgaaaatgctgcagaaaccatgttatcagcctaaatcaatgatttatgctctgaagagtgtgagaaaaatgaactcaacaaataattggacaggatttattgtttttaaatgagttttttaagggatgggatatacattctaacaaatttcctttagtaccttaaatagaatttcaagagcaaggtaaaacaaacatgaggtgccaacaaactattcactagtgactgggaaagagagggagagaaatccggagggagaaaaagggatcatatttattgaggtaatatgggaaggagcacacagcaactatcaaaggacttctttattgggtgaaataattgtaattgttttgatgttagaacttcacatggaacatttatattcactataactaacattccattagaaaatgttggatagactgtattaacatattttcctaggtttttttggttttgttttacttattgaaaatacatccagttaccagatatgccccttgcccaaaaaaagaaaagaaaaagatattttacagcatgggtacaatgtgaaattggagaatacgttagcatgtgctcacagctgtttcaaatgaattgctatagacttacccacagaacactctgcagaagagaggctaagacacaactgaaacctagagcactagtgtggtggcaaatggtggataacattacagaaggaatagcagtagtttcttgtctttatttatttatttttaactggatttatcttagaggtggtgattccatgtgagcagctttctcatcttaaaggtgctaaattgcccatctcacaaataatcaagttattgtaacatcatctatattatttatgcttggatttttttgaattgctcctgttttgcaaatcaaacagcagatgatatatatttgaatttccatttaaaagaatagattcttgcccctgttgaaatctgtaatgctcttatgggtctggtttccatttatcaagcaccagtgttttcttttgcattacagagtacttcaaatatatgcagctttctcatttggatattagtttttccatagatcacatatcaaagaaattttgtctgcacttaaaagggcctatctgtagtagtaataaaatgcataacactaaagataatcttaacaattcccaatatttattatgtattttcttggtgccaggcactcttctaggtgctttacatatgttagtttatttaatcctcctagtaattgtaggaagtaggtactattaataatcccattatacagatgaggaaagcaaggctcagcaacttgtccgagcaagctctgcagaagcaagcagagcttcggatgcgttatcaggaaagaggttcctgagcagcatataggccctcctaagaaggtacttacttttacttattaaagagatgaagtgaataaatatatttatgttttggaactttaaatatatgaccctttctgtaagaaaaaaataacacactgctctgatcagaatgtgttcccgtaaattcatatgttaaacctaatcaccactgtgatagtactgagaggtgaggtcttaggaaatgcttaagtcatcagggcagagccctcatgggtgggattaggatccttataaaaaagcttgaaagattaagtttgccctttttctatcgttttggccatgtaaggacacagcattctttccctcaggggatgcagcaaaacagagcaccatcttggaagtggacagactgggccctcaccagaaagcaaggctgctggcaccttgatcttagacttcccagactctagaactacgaggaataaatttgtatggtttataaattacccagtctgtggtattttgttatagcagcacaaatggactaagacatggatccctattttactaagctttttaaaaaaaatcagattaataagcactagtgttaaagaatgcatattacatactaggtttattcttcatcacttctaaccctctcatggataaaaccatttaaatctgttttggtgagagtcacatagtagccaataatcctatttagaataagcccactaagctttttttttttttttttccttgaagaagctaatcatctcatactgtctaagatttaatatttatttgcctacttatcttttgatctcaggatttagaatcaatgttcagaattctggagatggtagagatggtcttacacatccttgttttataagaaaacaacgaaagactctaagtcataggttcttcctaaactggagaatgggcttgcaaagagattgtatatgcatgaactttctgaaattagtgtacaaataaagtatgtaagtgctctatgttttcaagtggggtttaaatgttcgtgaaattatcaaaaggatccagcttccccaaagagtgaatgttaactgcattaagtgaaatgctcaaggtcacattgttgtttaaactgaaatttagttttcagttttctgtctctttattcagtatatttcccaatataccttaaaacgtgagattaaacaaacaaaaaaacacacctgaaaatcatttctgtgtcatttattctttggaaaaattcattttgacttggagtctaagaacacaactgaagatctctagttctaagatttctatcctaagtgtttcaaaatgtgtatttgaaaattcttacacaatcttcccagccaaaaaggcatcagttttgaattaggtttgatgtacacaggcagggctattatgatttcaaaagccgctctgggcctgcgtagactaatgggaagaacagctgccttgagactgacatatattagtattttgaatttgtcacttattagctattgatcatacttaagtttgctgactttttaaatgcttccatttcctcatctgtaaattcagatcatgacaactagcttttggggttgggcctccataacatggtgctcggcatgtaatagataaccagataatcatatctattataatgtcttgtctttgttgttgaattgaaaagcagaattttaattttgctttatatttagacttggctaacacttttctaaaaatccatgtcaatagggcttttaaaacaaaatgttaattataatcctactaatggaaacagtactggcagcagtgaagattaattatactttagaacaacaacctcttttttatccacaactgcaataattaatttttgctaattagaaggcattataataaataacctgccactaattgataccccttggtcaacaagaaattaaagatacatacaacaatatttaaggtaagcagatcacctgtattatcattaggtttacatgtacttgacatttgttctgcaatcttatgactctggtccacctgaatgatgcatttgatgattcccatattgtgtccttgcctcaggttagtcatgccataaaataggaaatgagataggaaataggaaatgaagttctaaaacctaatatttatgttatccataaggctaatgccaaaagataaaatagatttttaggcaaaaagataagactgagcttttccacccatgctaagtgacttcagacactgtcacatcctgcaccggtaggaaagtgttatgagtgatgtgggaaagtggaagacccagaccaggaatcagaagagctggattctagcaagttatattatttatattctgtgtgactgtgtgactctgggccaatcctgtctgagcttcagttttctcatctataaatgtgaatacctatatatctagtaaaatactcacactgccgcttcactagactgttgtgtacagccaataaaacaacggataaggaaactacatagagataactcttagaagtcagaaatgaaagagattaccactaagaaaactgatattcagagaagtcaaggtcacctagctagttagtgacccaacctcagatttccttgttcttcatcttttggtttgtccattttcttttcctcataaaaacatactttctgaacaactttggattctacaagtttaggcataatattatatattctgtttatgcacatccaagtattagcttccaatatccaagtattagcttccatttggtctttatttgaaaatatttaccttttctttttttttttttccagatggggtctggttctgttgcccaagctggagtgcagtgggacaatctcagctcactgcaaactccacctcccaggctcaagcaaccctcccacctcagcctcctgagtagctgggactacaggcacgtaccatcatactagcgagttttttgtagaaaatatttatcttaactcattacaataaatcctattgccctcttcttcaggaattactattttctcttaagaactgcttaaacatagaggggatgccaatggtaattggatttgtcaaaaattcaattctgtttccatactgcttaccctataattaaacaattgaaaccattttgtaattaggactcttttgaatttattctgcatttttcctagcctaaataaaatgactgtgatttggaaagatgtcaccaagtgtcactattttcaaaaagttcaataagcacattactgcccacacacaattcctgattcttttaatttttccctgttattctctcagtggaagtaggatatacacttgctctactaaacaaatataaagacaacatcaatcactgcggccacttccagtttttgttgttctaatgtctgtcagatcactttgcaaaataatgtaaggagtaactagcaccactgagagaatagaacaaaaacacccaaattaaaactctcaaccaaagtcacttaagttagtaacattggttggaacacaaaacaagcacattaagttttataaattgtgcatgaagtcacttaatatttcagtatactaaaagctggccctgtattatcaaagctgtctttagaggagaagcctcagttagtggttctgtggttccagttgccagtattttctcttctgtgtttaagatacaggatgattgactgccctcaagaatacctgctggttagcgcttagtttaagataaaatgctgttcacggttgtaatttagatgaaagctctctatagctcatgaacttcaattaaatgcttctaaccttttgcataacacttaacatgttaggtcagctctagatttagggtgtatttgtgaacacagcactataaaaagacaggttttcgtgtgattcaagtgcttttgcttttataatataaaaccagcataggaacgaaatgtgcatagttttcaaccatcagaataaagatacaaggaggtatagtttttatccctcaacatactttaaagatgtggaaaataacaggttaagaaaaataatgacaaagtgagcaaaagtacagcgaagtggtagttattgaatgacctaattcttagtggaaacaatgctacaatagagcagaggcagactgacaagttccccaggcgagaccatgccaaatagattctcaacttacattcatttattttatttcaataatttaccttgcttttgctaatggaaaaaagatttctctctgctatttgtgactcagtttagtttttcatttattatggagatgatttaagagacttgagaccccccacaaaaaaacctgtattttttcacactttaaaatggaaaacatagagataaatgtaaggtaatcatccacatatgttaattacagtttttaaacagaatttgaaaagaagcgattacccatttgacattattatgcctgatctagtattggtaaaattttaataaatttaaataattgttttcagtgtggaaaaaggctaactcttgaacacttagtatctgtgggtgcctagaaaagggattatagtattttccaccatccaaagtaaatttattatgagaattttacaaaatatatctatgcaaaacaatgccatgttgaggtaaggagggccacaggtataggattgttcaaatgctgaaagatagtttttcttcccaaaaaaactggaaacaaatgtattaatggcctatggtgcctactgagaaagcttttaaacagtttcactttcaaataaattttggacgttgaggaagcaggtaggagatgtggtcagagttataaaataaagcggtggtcagcagagattttggaagcagaaaacagggacaggtactcgaacaactacagatgaacatctttcaactataaagtccttaaaataactgggtctgaagctactataatttatttgttttctaaaatatcttcaagaatgtaaacagtgaaccttcaagtatgaagaggccataaaactcttctgggcactaatgagggtgaacatggcatgtgccaagggtgacccaggttgactgttagaggcacagatttaagtggcctcctaaactattttctaaggactttccaatccaatgtgctcctgtagccagagtaactaatgaaatactgtgtgttgaagatgaacttctagttgttttaatatgccacacaaaagggatttatcattggaaaaatgatccgtcatgaatccttaatgaagctggatagagttgaggagcaaccctcatcttttaggaacaatcatgccctctggaacacactccttactgcaattctaagaggcagattaccaagcagtccacaaattagataaattagacatttccaacatacttaatttatattaaccaccacattatcaactttgaaattttagacagtccccagtggatatccagatttatttacaagcaaacaatcccctctccccttttaaaataaccatttagtttatgggcctcttctgacaatcacctgttcattcataacaaccaaaacccatcactaaaatgggcaacctcaattcgcttcccatataaaacatcaactacattatcaaatctttagggtaaaggcaagaaggtaatgagagatgcacttctgtcatatggtgtcagggatattgtggcctatgtataatttatttgtgtgagaaagaaaaagtaggaaaaagctatgtttgaatcttaattactttctttttttctttgagatggagtctcactctgttgcccaggctggggctggagtacagtgacacgatctcggctcactgcaactcccgcctcctgggttcaagtgattctcctgcctcagcgtcctgagtagctgggattacaggcgcccaccaccatgcccggctagtttttgtattctcagtagagatgggttttcagcatgttggccaggctggtctcgaactcctgacctcaggcgatccacccgcctcagcctcccaaagtgctgggattacaggcgtgagccaccatgcacagccatcttaattactttcagagatggttaataacctcactaaaacaatattctcatgcacatactcaaatccatgaaaataaaggtatcagtgatgtctgcatttccttaccttctatagctgataggagaacccgggaatgatcatatgcgattacattcgcgtatctattctttggtttgtttacttccaagtttgaatgttcccaagtgaactgctggccagggtcaattgactttaaaaggaaaacaacacatatacacaaaatcaatactgaaaaccaccagattataggcatttatcacatgtaataaacatgatttaaaaggaaaattctgaagccatacttcatcaagatgatcctaactgtgaagctgaacactaatgtaaccagcataacaaaaaatggttaatcactgcagaaacagtgatagtcaccaacattgattcaaatgaaaaaagaaatcaatacagatgttctgttaatattggaaaggcaggttcttaattttacttttccatttccctctctgctgctgtagtttacaagtcatcttggttcaatattccttccggttctgtaaaccttattttatattgattattcttccctattctttcctatctggacctaagctgagtctttaagttaactggtctttcactggcttcaatggacacaggctttactgttcattctttatctacatgttcacaacttaatggcaacttaaggttttgtctgtttctctgtaacacactaagaccaatattacaaggcaaattgtacaatttaaatagttaacacgaacagtaaagaagggaggtcagttaatttaatactcagatgaataagatacaacccaatgcatataaattgtttttctatttatcattatatattttctatttattattatgtgttattatgtttatagtttgctttttattcttgattttaacattagtttttttttctgattttatccctttctttgatggtacatttcaaccaaattattcaacaatctaaaataaacatcaaacaggtatataaagtatgtaatttaaaaatatttaagtagaatcatcatttcaagaccaaattcaggtttgatcataaaactctaggggacttcatttcctgaaacgttatggaaatcaaaatactttttctttcatcataggctactgataacatttaagatttataatttcattgttatatggaaacacaagttcattaatgacacaaacatgattttaaacgatcaaaatcaagttttcaagaatgataaaacaggtttatacccaggtaatttttttaaaatatactctattatgttaacataatttttagcagttatttttgatgccgggtatttttcatgcctttatgtgtatatgtagaagttgggagtaaaacatacccccaacagcatcaaaatactaaagatgtgcacactttctgtcaaaaggcacagaatttatcacaacagtaaaactcacaagtgtcaaaagtcaagtctgttagtagtcttgaatagcctccaagcattctaaaattctcagcagtacagattccagcctctaatttactaaggattattaaactgttttcctttcttagcctgtgttaatctatatacaaaatagtcaatcaatgagcagtattcaggaaaatattaataattatccataccttagagtctgaaaactaatataattaagggactttctagtttgctcttccagggaaatttttcatctcccttgcagaaattaattatctccaagcatgctatgagccgaaggtattgaagcattcagatgtcctggtggaagccttcaagtcaaccttgaaccatgtccacacagaacagctccactcagtgatgagggcctgccttaaaaatctctcaaatttgcaatctcattgctacttcctacatccggaacattggtatctgttgtctgattgaaatcccttctctaatctcttattccaatccactcttcatactgctgccaaagttgtctttctaaagcatagctctggacaggttggctgcctgtttaataacttccactggctctgtgtgacctacagcctaaattctaaattcctacctatgcagctttcgtcatctttgcatctacactacacctggctcagtaaatggtccaacagatgttatttaagcaaatgaacagaattgatgaataaatgtttttgagaaaagttcataaagagaaatcatagagtaattcctctatataacatgagagttagagaacaaattatggaaacttcattgtacagtataccacaattatcatacttaacacccattatcatatggcttagtgattaagtatgtgatcatggaattataactaccactgctattccactttatactgatgaacattattggatacataagcttcttacacatcatttaaacatcccaagaagctactaagctcactggtatacgtacagtgctccctctgatatccttgttttacttagactaagatcacccacagatgtataagatggcatgcatttacttatagcaatgaaattgcatctattaactgaaacaaactgttaactcatgtccatttccactcttgccacatgttttcagccttctgtaggacttacttgatacctacattgaagactttaaaaacgagtaacagaaacatgagttgtgtgccacctatgttagataatacgcttaggttcaaagtgtggcccatgagatgaagaccaacaaataacaggataattataaaaatacgtgctaggtcattatgctttatatgaagaattatgcttgattttcacaattgttacaaggtaggtattgtttttttccatttggcaggtgagaaaactgaagtaaagaaagattaatttaattattcttactgagggcctacttcgtgacaggctctgtgctacttggtacttaagtaatttggctaagctcacacagctagattcatacagttaccctcaaaccaggtctgtgtgattccaaagctcaactgataattaacagctggtaacgactaagccatgatactacttaactatccagaatgccactgcaaaaggaagaagcccaacttaagaaacacacctacacatcactatcctttatttcaccaatccaaatgatatttcttcccaacttatcagcctgtgtcattctggggcaattacataagaaatcaagttttaaaaatgaggttggcttcacatggatgataaaacagatgggatgcagcttacgtttatactcgttttacacggatcaaacaaacattgattaaataatgctgacttgtctttgtgcaacacagcactcatccatctgtatctatctgtctgactgaacgtttaacaaaacacaacacgggtcattatttttggagcttgtcagaatgctgacagcagtaaactcagtaaagaataacaactgaaagttggtgaggtatactaagatctttcatatttcaaaaaatacataaaactggttgaggaaaatcaaatttcagttatccatattactaagacaaagagatcatgaatgagtaagaccctaattgctggtgacagacacagttgctttgcctctctgttctcaggcttctcttgctgctgtcctcttaaggaagagtgagatggccaaaatgaagaaagagcaatgtagaccctgaggaatgtaaaagttgactttcacttcaaccctgtattttcggtcagtccaccctgaccatgcatcttttttactataaagctaagctgaggttacccaaatattaattattcaaaacaatttgaaataagcacctttgttcttaatggactcaattccttcttttgggtctgctgctgttagtgtttggttttcctgagcttgactcctagatatgtctactcaactctgtccacccaaataatcttccatgggatacccttgccttcccagcactcaatctgaagttttaccttcccaagctgaaatcctggccaggctttcttcagtctccgttgtggagaattttgcaagttagaaataaagcaagctagatttatttaagtaaaagttgattaatacacttttatacatgatacgaaatacataaattatcacagaattcacaaaaatgctacttcgtcgtattttttgtgtctccagccaatcaaaaagcctcttgaaagacagatattggatgaaccccatatagcgtctaaagttttaccaagatgccgcaccattttacattgcttccctgcctgcacactgggcacttgactcctcctccccaccgcagcttttgactaaacctttctaacgctaacaacagatcttcaactcaaaggctttgcttactcagaaaaaatgacccaatagaagaaaaaatcctattgtgagtgatttaaagaacaacgggaaagtctcaagcagatacttgctaatataaaacactttgcatttatttagtctttaacttgatggtctgaaagttctaatcctttttatttgatcaactagaagtttatctcaaactaggtaactgaaaaaataagctatagcagatggattagaggtttgcattgtattctcgacaaaaactcagaattaaaatataaatatatccaatagttgtaactaatacttagataacatttactatgttttctttgtgctttgtacatactaactcatttatcttcacaaagaccctagaagtagttgccattatgattacagttatgtagatgaggaaactgaggtatagataagacaaataactttctcagggtcaaacagctagcagggagagaggccaggctgggggtccacatattctggccctggaggctgagggcccagccaccataagatgctttctctctagttaagctggagaagattccttgaaggtttcacacttgcctttcaactattctcttgaaacacaacgcacagaaggttgggaacaatctgtgtagtactgctgaactctatttgtaattctaaactccaaacaagagagtgatcatcaatttgcacatcagattacagtcaccaagtaaaattatatcctgatatgggagtaacctttttcaataatgctgaagtcattatcttaaagcaaagtcctttaatcattctgcaaaattcaacctttttacccagaagaaaaatataattcaaatgtgcaaaacaccatacaatactagttgctctgtgtttcactttccctcatcccgccaagagaaaaacctcaaaatattccctttagaaactcatcaaagagaaaccacaaaaaaagatcatcctgtttttgtgtgtttttaaaacaactaacaaaaatttaattatatagaaggaatagaccagttacttcactcgtcaaaccatgggtcagactaaccattctttttacagggaattgaactttcaatgaccttaacttccaaagaaacagtatcttttcacatatctccccttcagtaggctcatttggttcttagtgtggttggctctgagatattctcaagtcctttctgaggtttagaagagcaatctaccattcactgtgtattctgcaattatgccttttaaaattctcattcattgtctctctcttctctgtttgaaaatggtaaattaatatatgcccatttggaaaagaccacgtttgcatagatgggaagggctatattttgcacaattagtaaaagcctgcaattggcataatgaatactttcttcaaagagaagagcatgagttcagttgaatcctatgatgttttagaaactgaaatgtgaggaaggagtggaaagtccagtggtgaacaaaatctggaagtcagagaacagggtgttagctttctggctgcccctggttagctctggccggtcaggtaacttgggtctgtttgctctgtgttcccttttcctcttaatgtcaacctagtgtcaggtgtgtgtcctcattttctcttatctctctttgtccaattagttatcaaatcttactgagtctctctctgtaagagcacctctgatccaggccaacattagagtgtgaaggattgaaataaagatttttcaagactctcagtattaacaaatgaatggatgtgggagtgccccacctttagtagtagaaaaggcatagaaaatgtataaatataccacactcattgaagtcatcaaaaagtgtttcagtcacatatttttgtacacagttaaaattctggcttcagataagtgataaaatgcatcagctttacctgttgtctaatggttgcatttgaaattttgactctaacatactatataacaaatacgtatagaaaattacttaaagtaataatatatattattagaactgacatgcagggaacaaaaaggataaactatgctcatagtaaatcattcatccatggcaagtgagtaaatatctgaggtaaacttttgataaacaatttattctaaattatatcatagtactaaagatgaattagtttatttcactgaggaaaccattgattcccagaagtatattagaattatcttaatctaacgtggattaaaaatgatgaaaaacaacaacaaaaccaaaaatacttaattcttttttttaactcagtaggccaacatgaggtactctctagaattcagataaagtgttttactattttagtgtgtgactgtagaaaagattatttttgagagatcgttccaaataagaatccaaaaaagaacatacaactttaagattaaagatttaaataactagattttttactatatacttttttaaaattttttatttatcttttatttttatttttattttttttgtggcagggtcatgcctgtccaggctgaagtgcaatggcgtgatcttggctcactgcaacctctgcctcccgggttcaagcaattctcctgcctcagcctcccaagtagctgggattacaggcatgtgtcaccatgcctggctaacttttgtatttttagtagaggcagggtttcgccatgttggccaggctagtctcgaactcatgaccttaagtgatccacctgccttggcttcccaaagtgttgaggttacaggcgtgagtcactacacccaacactatacatggctttttaatatgccaaacattttcctgaatattactaaatgcagaagaaagacatttctagtttccaaagacaatgtgctagaggaataagatcagcgatatgtgttaatcctaatgttttcatttttagctatttatctcctacatcagataaggtgaataataagaaagagatggacagatttataggtgatgttctttttttatttcttcacatctttgaattctatatagttgatgttcttaagaatagaatgtgtcattggaaatcactttacaaatacaattcacagattagaatttctgatgttatttgaaaaagcaaagagtattaaagaatttccaggcagtttggggcaagcaaatgtattagaaagttattaaactgctttgtttaaatagacaatgttgactgaattggtaaaatgtaattacgatgacttataagaagaagtcacttgatctgcaaatcacttataaagtatgatatttaataattaaagaggatcctggtgaggtggcatgtgcctgtaatcccacctactctactcaggatgctgaggcaggaagacttcttgagccctggagtttgagtccagcctgggcaacacagcaagacccaatctcattaaacaaaatattaaaataggttatgcacacctagaaacattaaagagtatggcaacattaaagagaatattattgagtataggtaacagacaaaattatctagcaaatacaatcaatgtgcagcattaaacactaatttacggtgttagtaaattagtgttttagtaaattaggaagaattaattcacagctgcatcctttcttttccatggataacaaggtcccagtttttgccaccaaattaactagatgaatgcattaattcctcactgctctttgaaaatgctgacacatctgtatagatcccaaagtattaagcgaaaagtacctgatgcacagttattactaaaagaatgctagatgttttgccttctcttgcctctaccctgtgacttgtataagaacatccctgatagaagactatcttagcctccaaggaatatctgcattctccttgatgctaacggtgccttttttgatactgaagtataaaactgaggcaactgctcaatttaacaaataaatctatttctgctctcctacttactatataacatgcccatctatgtaatttgcaaactgatttacttttccggcagagacaacaaaaaagagcacagctgcatatggttctcactttttgcatttcatataatagaaacttgaccactcagaaaactcagtacataagtagattcaaaagaaaaaacaaattatgaatgaatagcttggtttcacaattgttgtgcgactgatattacaacatcatttaagaaacactataaggaaaattgttaagataaatcatcttcatttttaaaagtcggattagttgagcttaagtgataacagtaattcttttaatcaaatatgaaaatgtctagcctaattttaaacatacgatttttcttcctattatttttactttgcatcctaaacatagatgtattttaggctttcatcattgctttgcttgtcatttaacagaaagtttctttattaagtctttgtttctttttccatatttagtttcagatgcaggtggagggaacagatgaatttctaaattgaaacataaattaacttttgttaatgttcagtcaatgcatttcaaatctcattttctgattcagaaagagataaaaattctacatccaaaatgaaataagaaagagtaatgttttctcccagtctttgtcggaactcagaaaatcccaaataatcacttaaaaaactcttgtaccccatttcataccaaatgtatttagtacaactatctcactaaaaaacatgactatccacatgtgccttttgggcacagtatatataccaacaaccccttgccattaataccattagtgcttgcaggtaaggtagcaatacaccatactaaatataggcttctaatcaaagaagtcacacaggatgatcattaatacttatatccatggtgctcaggtgtcttagaaagtatttacaatctaaagtgtcagtatatttgtctcttacatgtgataaaactagaaaggctagaacaaattaacacaatctagaattttagagtttagtatctttctaaactaaaagattactctcaaagattagtatttttaaatgtatattagttttacattgtaaaattagggactcttctaagttaaatattagaaaaaaaatcagtacattgatgatcttatgtattagacctctggaaaaaatggaatcacttgagaacactgctatggggttgtgatttatctgatgttgtatattttgtatttagcatacagtgaattttaaaatgtatttgtggaatgaatagctaagatacattacaggtaggatacacagcaacaattacttttaccctagtaccttagaactagttaaataaatttctcagccaaaggtgtgatgatgaaacaaatatatattggaatagaccagagatataaaaaaaaaaatttaaataaacagaatggctcccagctcacaagtggctacaacccaattcataaaagccatctttgactttttgtgcatctgaaattcattctaagctatcacctgtgacagccttttgtactgtgttttccaatttttacatatgtacttaatatttggaagtaacacataatggctacttgccaatgacagttctgtataaactgtattacccaattttctgcacagcagtatgggtttatacaattagttggctattttaatacaatagtttttttcatttttttggtttgtttgaacagttgtgctccccaaagatctcaaggccacttatgttgggagttatagggagaatggaaggaatgtgatcagatggaaggataaatattccagaatggagctctacaataggctgagtttgagttaggtagtccctacatcccagtttacacctactgtcccagcgtagttattaataggaccctttctcactctcaaagtatcccagtttaggcaagaaattacatggccaccccaaggtagagctggttctacctaacttcctcatattcacatctatatctaggcaagcttcatgacagtgtcataaccatcagtcaggcatgtacatgtacggggagggaaggcgtgcaggggagcaggagagagggagggagggagggagagagggatggggagggagggggagagagagggagggggagagagagagagagagagagagagagagagagagagagagagacagacagacagggggcagtctctgctaaaaagtaagtacacttacaaactatcacatggataggtgggtgggaaaaagtaaagagaaatttctgcagtgcaatacctatctccaattatctaacactattgatgcagcaatgagatactgaatccagaatgagagaaggtagctgaccttaccatgattcacccttgttcaccttaactatggtgctgcacacaagagagaaaaaggaagaaagcagagaatgtgtttctcagcacacatttactgtgctctctaacaaaccaacaatttagccctttctgataattgctttttcctccttctaagacagcattggagatggaaggaatgtgcagtacataagctggctggatatgtattcaattgtgattggatatgtattcaattatgatcaaagtaaacgaactaattttacaaactgataattcattctatagacatgatttttaatcttgtatatcacctataatattttataatatttaaggctgtgattggaatattaaatgtaattatgtcataatttcttttttaatttttaatgctttggaagtaaaaccatagacctattgtttgagtattacacaattcaaccatgatacgtgtctccaaatgtaatataatctaaacagtaaaacataaattaacatgtcctttaaaaatctgtgtattaacatatctaaaaaaatgctgtgtcagttagtaggagagaaagcaagccacagacatgcagacaatggagggccagggaggacgatgaccatgaaaatctggtcctctcagaatgacggtagcatttagacgtcacagcttcattacatggccaccaagaccacacaactaatgcaagtgaggtttccagaaaacagatctctctcaagttttagaactaagaagcaagttgtaaagtgaccatatcaaggtattctcaaggtctggaagcctgtcttgggatcactttgccttctctacctggctcaattcaccccactgtgaagtcagtctttgattcatccatttcctggtgttagacttcagatactaaactctgtcagaaagccttaaaagtgaaaaaaaatatttcccctgaacacatgtatacaatcatttaaaataactttgaaaagcttggaaatagccttaatataatagtagattatatgaaaaagtgtgaagctattaaaattgttatgcatctagtgacgtggaaagataaacttttactgttaaagaaaaaacatgaaacagtacttttgttaaaatatatacatatgtatacacatgcactgcatacatacatgaatacacacacatataaaaacctagaatgttatacaccaatgctatcagcagttatctctgagctgtgataaatgacaattattttatttccttatgtttactatccatgttctttaatttttccatttatgaacattgaactactttccaggaagagggaaaaaagagagttgcagaatacttttcacaactgcacatgtgacttcctcttgtcatgtcagaggcagaaggagcagactgtaggactcaacactctggaggggattttgtgaaatccatagaaaatttttcagctggcttttggggtccatgaaggtaacttcagtgtagatttatgaccaggaaagaatactgaagggccaacacaagactagactgtcttactctaaactcaccaaaggatggtagtgagaaataatcaggttaaattacttctgattttgaggattatgatgacaatgaggggtggattatcactacttacagaatctcatgtaattcttaaaacaaatttagaggtatcttagatattgttatctccatattacagataaagaaattgaggcatagaagggttaagatactttccatgagtcactcttggtggtccataaattaggagaactgggatgtaaatgcagagattcctgactttgaagacagagctcttaactactacactctaatagatacgtaaattataaatttattatcatggagcataattccttatttaaaaactgtggacagtaaggaaaatagattaaacaccagatacctctgccaattttggcttaatgatgcattcatcccacagttgttattgccaaaattttttgataatgaaagacaagccacagctttctataatatatcgttagattctaacatgactcctatcaaatccaaaagagtgggaagttaagtataatctttactttaataattgggaacaaaaagacacatctcaagttctccctggtttctacacacccaacagtgctgccccaaaaccctcacacaccataaattctgcgggaaaagagagaaagctgatgcacattcattccttagaactgaatagccataatgcagcaaagggtagagctgtattggcagaaactactaagaatggtgagagaccaataactcatgaaaaacaagtctacactaacagttttaatgactattctaatggtttaatggatagcactttaataggatttctagtagaatctgaaagcttctgaaagcttgtcttcaataaatctgtcattaacaaagaactgcattgcttaactacataaccatagtttactgagtctgaacacagaaaaagtatagcagttgtcatcctgtattaccatcaccttttcaagtattctattaactactgtgagagagacagctacaagatcaaaatgtaggctgccagtgaaagaggcatatttatactaaggggatgcagtagacattaaataaaatacaacagaaagctcacaattatagcttgtgtccaaagaaaaagctgaaacagtaactgtaatccaaatacacagatatactaacaatgaaatttcaaaaactagctttagttctctttgaaagagtattaaatgttttggggtgatttgtttttgaatgcctattgcactctgtgtctacatttgacttattttgtattatgttgcttcctgtactgatttaatgttctttaaagtcaggaattgccatgttgtggtgctcagggtacataccaactcaatataaatattggattggctataatcagtcctagtgaataattttaaattccagcctttggctctgttttcctctgtccatgtctgaggttctcatttctgacttttttgcactggaatatttcttgcttggagagcactttcttatccttttcttttttttttgcttctaaattctaccttcctttcaacaaggttcagcttaaatcccactctcccaattcattactgcctggagctttctcttacatgcttccatgtgtgccactatcatgtgttacagactggagcatccatttggcaactagctacgtttagccttgtagcatttcttcttgtaaagttgtttgaattcattaccataacttatcttttcatttgacaattctttatttccccaactctatagtaagtttctcaatggaaatactgtctggtatatatctgtgtagtctagaaaatggctagcccagtgcatgtaaaatgtatgtaaaatacatttttttttttttgtaattttaatcatttcttgtctcaatttctgtgaaagtctttcaaggttgggaaacttatttctttcggaattacacgtagtcttatatataccaggatcacaaacctgaggataacagactgatgcattcttcgagtatgttctatcaatgctgatagctgtaaattcatagactttacagcaattatactgattatcaaaattactgaaaataacccattggctaagctatgaaccattcaagttgtacaacttgaacaaggcctagagtatactggaagaataaaaataccttctcagatccaatagtaggcaaatttgagtaaatatacccatgctaggagatttatatatgtctgtctggtgataatgtccttgtaaaaatggctccttcattcaaaatcaaaagcattatcacttgaggcaggagttcgagactggcctcagcaacatagtgagacatcgtttctaaaaaattttaaaaactcatcacaaaagatggtaatgcacacctgtagtcccagctacttgggagcctgaggcaggagaatagtttgagcccaggagttcaatgtcgcagtgagctgagatgagatcatctcactgcactccagtctgggagacaaagcatgacccactctccaaaaaattaaaaaaaaaaaaaaaagaaaagaaaaacaatattattaatcaagctattcaataaaagtaaacagaattttattctgaaaaagacaatatgtttgaggtcatttaaaacacctattgtttattaagaaaacttattaagtgatagattcagtctttacacagagtgagtcttatttactccatttcaagggtatgctttgaaaaccaaacaatatagcgaacaaaaaacaaaaagcctaaacaatttcataaataacaatatgggtaaagtaacaaacataaatggcacgctctacaagatagagcctcttttaccaatataaatattaaaatataagcaggtcatcttaaccaatgatttacaataagggaagaaaagaaaaatatctatatgattctttggcatctcatatttctttctcgggggggcatatatttcatccagctaggggaattttggatgaaattataaaacaaaatactatgcctgttaactgctcccacagcttagagaaaccctaagaagttctgccagggaagcataatagagaacaaatgctgttccctaatcttatttcacatacattcaagtaacagaatatgagaaagagaaacatgagttttccctacagcgggtccaaaaatctgagagtctgaaggattgatttttctgtttaaaaaattaggaaatactttgaaacacacattttagacagttgctaagacactaactgccctgacctactgaatttccacatctttgtatgtattgagtgtcagaaaaagaagaaatcccatcacccctcacatggtacatgtaacaaacgtagacaaaaatgccagtcccattaaccatggagtaaaactcatagctgcataccaaaatcctgacaaattctagttattgtggctttggttaagtttggataaaaacactaaaggaacccttggactcagaattcaagggcaaaatttatgcatcatttatttttgtactgcagagtctagcaaagtacctggcacattgtaagagcttagtaaatatctgttttatgagatgagctgaatataaagctggaaaattatatagacttttaaagaaggagcattcatgatcttgaaaattgtttcttaggtagctaaaatttttatttttatttatttttaaattttttgtagctaaaatttttagaattggtcttcttgttctcaaggccatttgggagaaatgagcagctttgtttcaaagttcatctgtttattctccagcgaaaattataatccttggtctgtggcatcacaattggttgctgtgggaatgattatagatcaaaaacaaaacgattatatcccttttcaagagcaaatgagtaccaagagcagatgaagacttaaggaaacaaagatgttcttttcatgcaaatatttttacaatacaactgtggagagataaatactgaagctggtagtctttatgaaatttataggcagatttttagctttggggaaagacagctccctttgccctcagagttagctttgagacatgaatactacagatcatttttctttttttttttttttaaaaaaagaaaatataaagacactgagagcgtaggaaaagtgagttctgtgatcagtattcccctgttgttttatttcaggcagaagaatgtcttcctcatctgtgtacaggatcactgtcagggagcttgatgtcctgcactgtcctggcaatatgttgcccaagggaggtccaccaaggaaagccaaaggtgaattctccacctagaaagaggaccatgcccataaagttgctgttcctccgtctccaaaagacttctgctgcagcacagtagtagttaagagttataacctaatgaagcatgcttattcatgacttgataaatgatatctctctatatatcatgtgactatgcttggaaagtgggagatgcaaagagcaaactagactcctccttctttctctcttttgcaggagatgcagagaaaaccaacctcctccctctttctctcattccttccttctctccctctctcttctttctggcttttctcttccttctttctttccttttctttttcttttctttcttcttctctcttctcttctcttctctctctctctctctttctttctttctctcaacttatgcatgtattaattccagaaaattttaccatgctagtcacaggaatatcctgataaacgagacaccatgaagaagctttcataatagcagaagacacaaaagtaaaactgaagaccctgtaatcccttgcaatgccatggattcaacacagcaaacagcgaatcaaatctgccatatacacagtgacaggcacctgtatcaccctaatcttggccttgtactcaagcctcaagctggagtttggcccaaattgacaatggcattttcaaacaactcctcagtgcccttagtttccctccatcaaatgtttaaaagcaatacaaacaaaagaaacacaaatattcaccaaaggtagaaaaaaaagcccagtggtcttcttgattctttataatatacccacttaatatttaaatataaagtacattcactgaactttttttttttaaatggtgaatttgcccgggcgtgatggctcacacctgtaatcccagcactttgggagaccaaggcaggtggatagcctgagcccagtagttcgagaccaacctgtgcaacatggcgaaacctcatctctacaaaaaatgaaaagttagccagtggggtggtgtgtgtttgtaatctcagttacttgggaggctgagatgggaggatcatctgagcctgtggaggcagaggctgccgtgaaccctgatggtgccactgcacttcagcctgggtgaaagagagagaccctgtctccaaaaaaaaaaaaaaaaaaaaaaaaaaaaggtaaattttatatgtgaactatattgcaataataaaatgatgaagaaaaacatataaaatatatcacacaagtttatttctccctaaaactgccttatttcttcccataagtaaaattcctactttatcacaatccttgtaatgtttataatttgggttctcacatagaaaaacaaacatccttaacgtttcaagttaacatgactttaggaggtaatatgatggttgtttatttttcagaaaacatttttatgtgtttgtttttatctagggagtctacttagaaaatgtcatctattgcataatgttagatgtaaacttgcagagacttcagccacgtcacttaactgccctgaaaatgtcttctctacagtaaaataacagcagtgaacgaggttagaagattctagaaatcctcaaatataacttcacagtagaaactttgtgacactgaatttaaacttaaacctctaaaattttatgaaggattttttaaagataataggatgatttcttgagctgtgacaacaaggatcaatacagaaggaatagaaaaagaacaaaaatggaaatcaatgcccagttgcacggcaacatccaccaactctaacacttagactgaaaatttttattctccttgtgtctcaacagatgacaaggaggtcaattaattactggtagtgggtggtaaaatcttctaccttcccttatgcagcaccctaactgctcttaataaaaagggaggcagcatttcattgttcattaactatactaattatagcttctcaatcactgcagccacataggcactcctgagttgtagaacggcaatagaagagactcgacctaagcctgcagggatgggagtaggggaaacacagcattgagaaaacaaaaagggaaacctgacatcagaatctgaacgttattacatttacattaaatcatgtttcataataaccagagaaacagaatttcagcaagagagaaagaatctaaaaagatcgtccagtccaatcacctaaattatgtttgagcttctgcctcgtcaatccggctcaataagttatatgccacctgacatactgttcattttaacagaactaaaagctggagcaaaagcaaacaaaacaataataacaataaattcttaagctaatggaaataaatgtaggtaggcagtggttttgtatcctcctgccatcttgaaatacggcaagcatcttctgattgtacagtaacagctcctatcttttcaaatcatttagcagcttttgtatgaaattaagttgcagaaacatgaaaggattttgcatatatgaaaaggtgtttttagaatcttaaaggtgaatattactatgtatcatattaaaagacttataaatcataatttattgtggtgagcaagtttccccttcttcattggtcttatctaaatgaaactggaatctgactcgtgatatgtagtgagaagggcaccttgccagtataggtctcacttttttttaatcttcagggttagacaagtaggtagactctggtctataactgacaatgtcaaaacaagaaacaagtcaataccaactatcccctgtgagagttaaggctgagtctttacacctttaaatcccatcaaccatctgctttttttttccttgattttatttacctagatcaagatcagaagtcaaaggcagtcactataatataggtagttatagaatcaatctgatgaattatttctagcccaactaatcaaatatatttttctgtttgacaagcttaggatggaatgctatttgtttcagatataaactataatcctttcatcatcttcaaacttgctaatttttaataaaaattaaacaagagcatgaagcgggtggctgggtataaaggttcctatccaaatcatttaaaactaagtcgttttgttgttgttgatagactgtctctgatgttgaaaagcaaaaataaaatataattataacaaaaagaaatttgggacaataatccttccttggggtcacctgactactatgtgatcaccttaacagataagttaatgacaacaaattttccatggtgaaaactgtggtgaaaggaaatcaactctcagaggcaactatttatagtggtcagaacattacccagacctcagactacacgggttcatatcctagctttgccatttactagctgtgtgaccttgagtaagttacttaactttcatgtggttcaacataccttctgtaacatggggagactaacagtacctacctggaaggactgaatgagttaatgtttacagtaatgcattccgaagaatgtctggcacatggtaagtgctatacacatgtttgctatcaccatcatccttgtaaagcactatctagactctgaaactctatggaaagactattatgatattaaaatgtgcagtttaatactaaaaaaatgatataaaaatactctgttaaactggcagaaaataaagaaggggactgggaagaaaagggaaggaaagaggaagagaaggggaataaaagaatgagtgaagggaggagggatcatgagagaaagaacaaattaaatcaggggtgtctgtgagccactggttgaagtttagaggactgatgagtgcctgctgttaaggaaatttttttagcaagtgatatataataaagttctgattatgcttcatgcatgaacttttaagctaaagccaaatactctgattgctgcatctgtgacgatggaaagactaatgtttcccaaggcctagccaaaactgcaaattcatgtaatctcttaatgcttacatccttcactttcatctacactcccaaagcatggtggtgtgcccaacatttgttttttcaaaaagaatgacaaactgtttagccacagtagaaaaaccatgacaaataatactgccactaccattttataattttacaattaaatacataaataagtaaagtcatccctatgatgctgggttacatcaggctctaggcagccttgttccaatctcttcttgcagcattgttaaaattttccccgaaagctgttcccagcagtgacataaacatagacgtactcatttggtccctcaggtacttggagtttcaggaggaattgtaggaagtgatttccatgacttttctgaacatttttgaaatcacttggttgcagactccttcctatattgttatgacctttcaagggtgtaatcacctttcacacctcacctctcagcagcatgaccctgagctgcaatgacagtcacagaatatgttgggaacccctgagcaagccacgcttcttctcatctccatgcttttgcatgcacagatccctcagcctgggggcttgcatttctggcaaacttcagtgactctccaagtcatgggtactctgggaagactctcgtcaatattgtcccactcccaagattaacttaacaattattttttgttttgtttttttgttttttttctgtttctcctagaagactatggactcattcaggacagcttatttcttgattatttttggttctccagtaaatgttaaacagatgaaggcattcaagctactcctcttataaacaaagaaactgagatcaggagagttaaataatgtgtctaggggcattaaaactagcagagacatcaggacagtttccattcgtcagtgaaaatacctttttttgatattttaatgtggatataatttccagaaatgatattatgtacaaaatatgaaaagaactctgtagttcttcataattaccctccatccttgtcaccctttaccttcccctaattgctttcatagagctcctttttggaagaatgagaagagaatgttatagaagataaaaatcacttgagaaaaaaaagtcatgttaagtgactgacagataggtcatgcatattgaagttcacaataacaagagccacttctgttgaccaagcgcagagggcaatgggccaggtgcctaacatatattcatcttcataacagtctcatgggtagatactaatcttctcatcttaaataagagaaccaaggttctgagaggtaaagcaactggctcaggatcaagcagcgtagctactaattggcccagtcaaaatatgaaccttgttttccctgacttcaaggccctccccagcatccactatggcatccctctaagtacacacttagcattccggtgctaaaatcccaattttactttgaaataaaaatgcaactcaataaagagtgtcttttttcagtccttgctatggtctcttggaagttgaaagcttgctttggaagcagagacagagttgtttcctgagagccttgggctccacatgggagcaggtgaaaagacattttggagaatgtccagtgatggtcaagggccaattagttatagagaacttgtatgagaacaacgactgagaaaaaatgaaagttgaaattgtatgagaataaggactgggaaacagaaaacgagttatgtgagagtcccttaagacgggtaggactcccacaagaaaaaaacaaaaggctctactatgaaagatacgaagtttaatgttagtaaagaaaatgtctgaggttttttttttttttttaatgtgggtgaaagaacaaacattttaaaagtctaagtagaactaagctttggaacttgagaaattacttgcactttgagttttcacaactatagaagatcagtaagaaaaaaagactataagcgcatagacatacgccctgttttggatgcaatgtttcttctaaggtgagctgctgtgtctttgtgttctactagatttgtttataagatgccaaaagcagcccactgggaggggactctgtactttttcattttacttggtgagactggtccttaactgcagaacaaagacagcatgttctcagatggccgactggtaggccaatctttgctataaaagcggctcagggactttattcagtaggtacttttgagttaaatctgagaggtctgcattaaaatgtaatcacttctgcactgtctagagatagtaatagcctattttctgagagaaaagagcctgaaaataaggcttcactgctgatagatcaggtggggatgtcgactggaaaaagcagctctttacagcaggacactctttcttctgtttgctcctgttgttgatactagcaattttgatcacaacaaagagtttctatgaactgtaaatttagttagaaattgatccagacacacactttggttaatcacctgctgtgtgccgagcggtgagcttgttaccacgtggccaacagcataccgagaggccagacacctgaccaaaacacctgacccagagaggcttgatcacagcaaatgactggagagtaagaaagggcaacataacaagtgataattgcactggtttaaactagcaagtttccatttctttcagtcttttattcttcttcttcttattgttatgattattattattatttttttttactgacatcagcaaagccctaagggtttggcctgggataggaaatggtagggtttcattgattctaagacatacatttcctttccacattctaacatctctgaaattgatgtgcatcttaaaattgatggcatcgtgcagttataggggtgatatcttttattccttagtggtacatgcaatgatggagtatcttaaaattgatggcacctagatgagataaaataagtaatagttactaagactactgagtactggtgtcaggaaacctgataagcatgtatgtgtttgtttttaatgattgtatgaagtaagtactatgactgcttctttatatagagatgaacaaactaaaatacagagaggttcagtcatttgcttaaggtcacacagtttgagctaggggccaaactggtgacctgagccaagggcctgtatacttagcaactgtgtcataatatttattcccactgctggctcaacaagtagaaagcccggagtggcaggcagagaggtttggacccaatctgagaagcagaaaaactgccatgttcgtaaggaattgggcaaagactctcccacacccacctccaatcccagtgtattaggagattctgatctggaatagtaaatttagccattcatcttcctcaatttcatccatcccaggtacaaaaatgttgttactgctttttatttcacaaaatcgctcatttttctcattccattaccaaaccaccataatttgttctcaacttttttaaaaacaatcttttatctcttgtgactcatatgtcaaaaatacttagaaatggaggccttcccttagaaatggaagagtctattccactcttccactttgcataaaagatgaaaacagatctctgtcgtccaccacttccttccttcaagaaagtgggggaaccaccttcaagaaaaaatccagtgcattcgaagttggccaaaaaaaattgtgtgtgtgtgtatgtgtgtgtgtttggtttcttgtttttgtttgtatgattcttgaatacatgtcccccctcatgagcttacacataaattataaactaatagaaagcagatatgacagtagttttgcattataagtgctcagaggtttacaaaacctaataatgatgactgttttactaatgatggttctgcgcctgtgaatacactgtggcacatgtggtcaaatataccaagagtcttttccaagggaaaatagaaatgttttcttttgtggtcattgcttagatgacagacaatttttgtcccctctgcggagaaatacaatgtttactatcaggagtgaacaaattatctatggagaaaagcaatgcgtccttagcatgtcatagagaaccactgggttttcccaggaatagtcatgcaatggaaattggtaactatgacattttcacagaaattttaaatatcaatattttgatctagtttgatactaaggtttctgaactctatcatcagggcatagtaagaaataaagtgtgaaacatttaagtgtttatatcaggtaagttaaggtgcagtgaagaagaacaaaacaagatgaatttgtgacctggttttaccacacatagtaggtgtgtgaccttgggtaagtcacttctttctcagtcttatgctccttacctctatgatgggagagtgaaaccacatgatctctgtggtttagacagctctaaatattaaaaaacatgacctaagcaatgtttttaatgtctctatacgtctcaacactgtcttgatgtatttcattattcatcaaggaaatatatttttcctttatctgtcttactgagtgatgggaagattttaacttactctacaaaggtgtaatacatattgttataaaaacagaaggacagggctctgatatctgaaatatttcatataaaagggtcattatcatcatcacagacaggagatgtgagagtgctgccatgagaacaggaagaaactcagcacatgtgggtgctgaatggtgggagacatgtgagcactgagactggagacagtccacatccagagacggcagcaaatgtgttgggactgggctttgtgatgagaacaaaacagatcaaagaggccttcttcagggaacacttctgtgaaccacagagtttcttgtccctctccaatggcaacagaaagattgctccgagttaatacatagctttaaggtaatactactaacagagctagtgctgactaacttgaaactagatgtctgatgactgttcatctctgtgtaactaccatgacaggatggactgtggtccaaaatgtgacttgtaagtgagctgacaggaactcagaaaaaatgctgttgttgtaactacttaaaaaggggttattatctcaacccacaccacaaaatgtataacatctagaatgtacctgaagtagagtatgtgatttgggacagtatttctattagaaaactgtaccttgaggaccacattgggaactagttttacattttctctaactttatagcttttcttgatagtgaccactgggatgcccattaattttttttattttttttttactttttttcagacagggtctccctctgtcacccaggctgcagtgcagtgacatgatctcagctcactgcagactcaaccccttgggggtcaggtgatcctcccacctcagcctcctgagtagctgggactacaggtgcatgccaccacgacaggctaattttttttttttttgtagttttgcagagacagtttcaccatgttgcctaggctggtctcaaactcctggactcaagcgatctgcccgcagcgtcctcccaaagtgctgggattacaggtgtgagccactgtgcccagctgggatgacaatttattacacaaagacatcatcaatatcttttaaaatgtagattctgaatcagtagcagtggggtagtacctataattctacatttctaacaagttcccaggtgacgccaatgctgctggtctgtagtccacactgactatgagactaccagaacgttcatttctcatgtgcctttcccttgataaaatgcacttcactcctcttcctagttccactaagagtgccatcttctcttcaatacctttctcaattctccagatcattatgacctttactgaatcccaataacattccagcacttaagattacctccttggtgtaattctcgtttgattgtatatacttgtctttgacaactacaaactccagaagtacaggtttcttacaacttctatattttctcagcactgagcacaatgcttttctgtagtactgtagtggataattattagttcctcctcccagctcacaagcctccttacacagaaacttcgctctcccccatctaagatctgtatgagtggactgttagcagttacgtcccaatgtgtgtcaccacaacaaacagtcaattagatagagttcagagtttgctctctggcatttaaaacatgactggcaagtacaacttagtctctttatggggcctgtacgtaaatgaaaatatgattacagaccatgttttctgtgcgtgggtgagaaaaaaagaagacgctggcttgtataaggggaagaataaagccaccacagagaaagcacaaagatgaaagctccagagaagatatcaggaaattgccacagcccttcagttttagatgatagttcttaatgtgtacctttactgttagccttggccctataatacatcaaaaatgctcttctgtatttccttgagaatttctaggggctgcagttgcttacgatctatctagtctaaataagatttgtatatatatgactgtgatgatgcctactgattaaattttaaatatactagtctatatgctatctcagaaaatggtgaaatgaagactgggggtcatgttctgtaatacattaccctaaaccaatgacattcctcaaattgaagtctttggagcacctgcatcaaagtcacctgaagagctcttttaaaatgcagatttgtggataccacagctgacctattaaactagcatttctggggctgggaccaggaatttcaattttattgtgtctctgccaggttttggtatcaggatgatgctggcctcataaaatgagttagggaggagtccctctttttctattgtttgtaatagtttcagaaggaatggtatcagcttctctttgcacctctggtagaatttggctgtgaatctgtctggtcctgggctttttttggttggtacgctattaattactgcctcaatttcaaaacgtgttattggtctattcagggatttgacttcttccttggaatttcaattttaaataggcaaccaaatgatctgtaggcgccagcctaagattttgtttggcaaggtctacacaaattactctgatttaaagattcaccagcctaatatatggactttaacagccataccaactttaaggaggactttcttccctgcattccagatgccattctcaaattgagactacttaaattccagcaggacttttcagtttcatctcagaaaatggacatctaaagtgtttataaagacctgcagagatggggttacactaatttatcaagtccattcttccagctttcactaaattcactgttggagttcaacggcctttacagtacaggaagtgtctcataggatctaataatactgtgctacaatttaacctacttcctcgtattctgacctcaggatcagtgcaaacagctttcacgcctttaacctgttttagtcttagaatcagagtaaaaaaaaattagcttcgtgcatcttacaagttctgagtaaacatttactcacagtgattatgccaaaataatcaggtgtttgaaagcaatgtgagttttctttcctccattttctttgctgaaagccagtaaaaatctattcaaatttatgtagaagataataaacaatttttccccacaaaatgttgctctgagcctaaatttttatgttgaggtcttaatcctattatcacagttgaatacaacacttaaacatctccttcatgccggttaaggcacagtagagtcaattcatgcccagggagctttaatcatggatcatcatcatgaacatcagtgaagagtctatgtgggctatcaggtccacagctaagcctactggggaagctgtgcatagcagcattgccagcatgcagttcataactattttcaagaagcacttctgatctaatggctaaatgaggatcattaaagtatctttacatgtagcatttcttgaaaattccacatttaaaagaggccagttattgcattcaatagatgcaactgagattgcttgagtgatggttttatagccatgtgctgcataatgacatttcagtccacaacaaaccacaaataagagactgatccataaaactataacagatctgaagaaattcccatcacctagggatgtggtagctgtcgtaacgtcctagcacagtgcattactcctgtggttgcagagatgttggtgtaattaaacttattctgctaccagtcacataaaagtcaggcacatacaattaggtacagtacataatatttaataagtgaatatgttactagtttatgtgtttactacagtatacattttattgttattttaaaatgcactccttttattaaaataaaaagaactttaaaacagccttaggtaggtccttcaagagttatccagaagaaggcattatcatcataggagatgacagctccaggctgtcaccctgaagacattccagtggacaaaacgtgaaggcagaagacagtgatattgatgattctgactctgtgtaggcctagattaatgcatgtctttgcaacttagtttttaatcaaaaattctaaaaagttaatataatttaaatagaaaaacgcttataaaataaggatataaagaaaaaatgtttttgtatagctgtacagtgtgcttgtgttttaagctaagtgatatcaaaagagagtcaaaaagtttaaaaattttataaagtagttacagtaagctaaggttaatctactattgaaataaacttttaaaataaatttggtatagcttaagtttatagtgtttataaagtctacagtagtatacagtaacgtcctaggcctccacattcactcactactctcactgacacccagagcaactaaaagtcttgcaagctccattcatgctaagtgtcctacataggggcaccatttgtttgtttgcttgtttgtttgtttgtttgtttcactcttgtcacccaggctggagtgcaatggtgcgacccttggctcactgcaacctctgcctcccaggttcaagcgattttcctgcctcagcctcccaagtggctgggattacaggcacacgccaccacgcctggctaattttgtatttttagtagagacggggtttcaccatgttgaccaggctgatcccgaactcctgaactcaggtgatccacctgctttggcctccaaaatgctgggattacacaagtgagccactgcgcccagcctaaaaatcttttttacagtattttttaccttaccttttctttgtttaaacacacaaatagttgggtatagtaacttgctgtaaaggattgtagcctagaagcaatgggctataccatatagcttaagtgtataatagactatactatctaggtttgctatactccacgatgtttacacagtgacaaaatcacccaagaacacatttctccaaaggtatccctgtcatcaagtggtgcatgactatattattgcccatggtttaaagttatattggtggagagtgaattaacggcttactaacaggtcgagctatcatatttccgtaatttgtaacccattacataacttataatcaaaaataaataattaaagcagggctatgaaaaaatatcacatggcaaaataataagaatcatataacaataaaaagtaggttggagtgatgaaagatttctggttcataaaaattgacataactaagagttttttatggtgccccaggtgctatttatgatttgccttattttctctaaactcactatggagccctaagccctaaattagaaactatagaaagtgttttaaaggatactgcataattttaaaggagctattctgatcaagaggaagagcaggaaagaaataagctgcgaccatttgagaaaagaagacaacgtgcaatccggtgtgaattttcctagcattgaaaatgttctcctgaatgcttggagcagaataaaggaagatataacttcaccaagaggcaaggaaacaaacaaaatctttgcatcctatcaaatatgtgacaaagatgctgcagtatgcaaactgaatgaaacgtggtctggctcttgagggtggaggtgaatgagactacagatatgttttggttttccagcacagtaacttaaaataatgaacatttgaatatttgaagattttgggaaggccatgccacaggcctcactgctctatgttctcttacatggagcttcttcttatttttgtgacccctctaagccacttgaggttgggggtcctcttagaggttactacagaatgtgacagggtagaatgttagcgctggtaggtccagtgcaactgccccaattaaggctgatacaacagataccaagaggtaacaggatgtgttaacgactcccagtaagtaaatcaatagaaaccccgatggtgaaatttgggctgcccaggtacccaataaccttttattatttggtatatctacaagattttagttgtacattttaatcttatgttaaaactggtctagaaaaaacaattatcgtccagttatcaacaatgcattaattggcttcattaagggtccttgttgctggagaataccagaaatacccagttttataactttttgattgatatataccacaatatccaaatacacacacacacacacacacacacacacacgcacgcacgtgcatacacacaggcttttaatttacctccatcaagaattcacaaagaatctttaaggattctggaattttaagatagcattcagcgcaccattccttcaaaaacaagcaactctctgaaaatacatttctatcttaatattagctctagcattaatttagattgaaggataagataatatacacatactcaataattacagagttttcatggcttataaaaccaagagtcttgagaaatgtacttaatcttcgtaatctttctttctagatgaggattcttatcacaaatcagtgtatttggcacctatttggtatgctggaaagcttatcaatttagtatattctaggaactgaaaaatcagaagacaaatactgcatgatctcatttatatgtgaaatccaaagaagtcaaactcatagcagtagataatagagtggtgattaccaatggagggctggcaaaaggggagatgttgatcagttttagctagatggcaggaataagctttagcgatctattgcacagaatggtgactataattaataataatgcataatatgtaaatatatacaattattgccaattaaaaataaaataaaaataaaaaacagaaaattcataatctcagcaagtaatattgaacaaacataaaattaactttttcaaactgtaattactatattgcttgtgcagacacttttaagttgacggttcattatacatttttatatcatatttgagtcatatttaaagggaaaagcactgatgaagttaattttcaagaatatggtcaaaaaaagagaagagtaactcttgaaattactgtaaagaataaacacagtgaattacctcatattcctgggaaaacttcaagttgtcatttgctttcaatctttcaatgtggtctgcaagttccaagatgggtattggaggatggctagccatacctattgaaaaaagcaaagaagaaacacatttgaaaacaaatgaaaatgatgctaactattccaaaatatagagaatactatagttagaaatggcctgaaaatatgtgagtagtaaagatgttttaggtgaggaagcaggcaaatagtttggttactcaaagcaggacatgctctgggaagatgaattttgtagccaaatgaaaagtcaccaagcataatctccaaactaacactcctagtgtaaaagaaagcgttattgtgctatgaatcaataaggttagctagtggaaaaaactgacagtcaggcttgatgtcaacttctgctttgagtaatgacttttatgccatttcaaactccttctcctgcactgtgtgaaatggaaattgtgtggaattaaatggtgtaaagtgaaataagaaaacagacactgagaaaggcctaaaagggaaagagtagtagcttgatagtaaacataaaatgacttatgcataatcaaggaaaactaacttgaagaatgaaggttaccagggtaaccggaatcatctgaacctgcaaaggaaatgatggtgtaaataaaataaaatagaacaaattcttcaaaaaaaaatgaaatggaaagcctgatatattttttaaaaggactaattaaaatgctgcaagtttttacagaattcactatacattgtggctagtacaatgtgactactacattaagatcgctaatatttcacaaacctgtaggtgactgacattcacatgcaaacacagacacaaagaatgacatgcaccacgactcactgacgataatcactgacggcacaatcagacaccaaactgagcttcaaaaatgtttccactagtagcagattgtagaggttggggttgcagccttctcctggacatttataaatggccacactaacaactctgtgatattttgccccaggtccccattattcaacccccagcaaacctacaatctacttcaggtgtaaacatctttgtccactaatgagaaatggattcagggaagtgagcaaatggtgaaaagacaggagggaaagagggtgaagaaagaaggaaagcagagatggggtgacacattctagttcattcagccagcggaagatatagtaatttcatagattccatgaaaaataatccactattaattttggtgactcctgtgtctttctgatgttttctcacttttcatatgatttgtcttttatttctttcctattaattttacagaagtatcatgaaagagcattgctgactcttatcttacagatataaattccagctggctacaaaaacctgaactagcatgtccccagggaagccactgaagcaggaaaagaatgagggaggagctcaaactggaagccatgtgttgacattctgctgtcactgtggctctttggaggaaggctacagaatgatggccattgagtcaacatgacatgtgactactttaagagcattttaggaattataccattgttaaaagtcacccagtaagttcctttatctcaaatgccaaattattaatggttctggtaagttaagtaaaaagctaccctgctttttgaagacaaccactttagcaagtgttgtgaattgtggtggtttagtttttatggctatgaaggtctgcttccagtcagctaaaattttagtggagagccaataaaactgaattgcttgcaagtagaaactctttgttggtgatataataatgcctttggaacaaaattttggaaccctttctgaaacttttctgtattaatgatagaactgaaataatttacattctatggaggaagtgtgagggtgacagtgatctgataattacgtgatcttatccagatgaggcacccccaacgaaaagaatggaaatgcaaaggcataggtgactttaggcttatctggaaatggaaatggactgatgtggacatcattacagtgctttcacagagaaaataatagagacaaagatgtttagaccttttcgagcggatcgtgggagagagttattatcatatatggactgagtggtggtttggctagagagggaggacacagagccaatcagggaggcgtaggggactgaattactgctcaaagctgcaaaaagtaaagccagttggagacgggaaaagtattagtataacagcagtagaagaccataataataaccaaagatgtgatcaacatatttacttgtggcatgcactggcacatggtctggaagtattatattggaagtttattaaagaaaaattcaagcagacctacattgagtcattatattccacatcagaatatatatacatatatgtatcacatgcaagatatcacagcattaaagaatcgctacataaaacttatcattggataccatattgcactccatttctaagacaagtaaaaatggcagatggatgtttcacagaaaagggaggagaatctgtgtgaatccaatggtacaggagaaagaaccctggcttagaatactggacatgggttctacttctggttttggcatctactaatagggacaaatcaccttttgtgaagcgccttgatttctttaactgttaaaataagagtatagaactagataaattcaagagccattctcttcttcataactttcattcttcccacatatagacagaacttctgaacagagaagggtctattggtgcatatgtaagggttctaaaagttatcgtaccttttctttgaagggagagagtacttactttttacaaaatggaaaactagtatgcagttgaattgtttattttttgaactatttaagtttgttgctattttctttcattagccaaaatgtatacacagtctattatgatgttatatcatatatcagaaaagaccgaatgtcggcataaaaataatcatcaagagtaaaactcctctaagttgaaactgtttagctcatatcagaaaacaatgaccaaggatctacttcaaaatattgttacacaattctgcagaaacatctccgctgcccaatattgaaaaaaaatgttatatgatataaacaaatatgttagattttgaatgaaaaggtagacactaagaaaactatgaatttgacctcactgtggtaccttttcaatgttttgtctggcaacctgaccactgctcagtctataaaccaaagtctttactacatcagattttacacatttaaattacttgatgtgctttaatttttttttttttttttttttttttttttttgcaggctgtacaccagaccaattaattcaggtctgtggatgtgggagctatatattgatatttttaaagttcctcagcactggctcttagtcctataggattcatgatggggggcctataactccatttattcctttttttcccatttagaaatcatatcaggatttatgagaatgagatgagctttctcttggtgatattcttgaatcctctctaacaccccattagcaagctttagtactcagctattattggcagcaaagaacttgaagcacagctaacaaacagggagggcttgccagtgtcatgacctcatcagttagaagctacaaatgtacaatagaaatgtattattttttttttttttgagatgtagtctcactctgttgcccaggctggagtgcagtggtgcaatctcggctcactgtaagctctacctcccgggttcaagtggttcccctgcctcagcctcctgagcagcgggattacagggacgcgccaccacacccggctaatttttatatttttagtagagatggggtttcaccatgttggtcaggctggtctcaaactcctgacctcatgatccgcctgcctcgggctcccaaagtgctgggattacaggcgtgggccgctgcgcccgacccataaatgcattttaaaggcacgcatcaaatctgttaagactttttattttgaagctatgatctccacaatatagagtcaacatgaaaaatgacagatgcggtcactgaaatctgccttaggttggaggaaaaaacaagatggctccctttaatagggtacatattggtgagactgatgtcacggtgacttccttataagaagtaaactttaaaatcatggcattttaacctgagaggcaccttagagatgacttagtccagcactttcactttatacaagaggactcaaatccagaaaagttagatgacttctctacataagcccagacagtaaataacaacatctcaacatgcagcttgggcatctttctactgtactattccgagaacggcatttgcgatcttctaaatgaagtggggggcaaagtctccacagatggaatgggctaggctggtaagataaatgactgaagagggctaagtatcatatagtcaacattttcacacacagaaaatacgctcattcccatttcctcacaatgagcaggtttccagggctggcttttgtgtctctactttgaacagagactccagaaagaacagtaattctttactatgtgaaaaacagccataagcgtgacataaatggcaactaacgctcagtctcaatgtcactcatctttagggctagtgtacacattggggggcttctgaaaagggtgaaattattcagctccaggacttgctctgccaagtgggaatgcaaggccaatcggttcagactgttcaggttttcaacagccactcaaaatccagagtatcgtgtggcatttcctcagttttcaatgttgactcaaaattttgttgaaactcagtccatgtcaaacgataagctcttttgcagaccacatacggctaactagattatggcctttgttttaaaagaacaaaaccttctttaatctgtgtgtatgtgaattagaatcaaggagtgttgggagtgacagactgcatgcttgtatccacaaggcaatggactagatactgctttgtgctggggatataaagaagtatgcttcttgcatggttcatcccctatgggttcatctacctccccttctctctaacctgatcccccattatctctaccaattagaaaaatgaagcccagaggagttaaagaactcgatcaaagtcatcattatcagcagaactgtagctacatgaggaatctgatcccataccccgtacactctcatttagcacatttcacatgacgccatgctgtctttccaaccatttaacacccctggacaagtggtgacatgtacataaagctgggtctttaagactgtttgggctctctatgcagcaagacagagatcataaaccatcctcagtttgtgaaaaagtgtcaatacagggccttaacctaggtcatctgtttcagtggtggggaagaggaaaaggggatgcaaaaacacgtctgtattttccagttatttcttgccaaaatatcctaagtttccaagaaaacatgaactaaaggtattaatttaaaatgttaaaaactggaatgctatttggcagaatatttcttagaagctaatttatggtatttttgcttttcaaaagtcctgctctgttttactaagtcagtaaggctactgaatgcttcaaatgattttattatccatagaaaaatatttatcaaacacttgctctattttcatatttttaaaccttgcattaaatgccaataggcactatataactattctgctaagtagagtttttgaagtcattaataacggtggtacatcttttacatgatttttttctgtcactatatacgtgtgtttgtaatgactcagtaacagtctcttcatgattttccttactgataaattgtgataaaggctggagaacagtttgtgcttatggaccaaagagaagctaattttttcatcaaatcaattaccacagtcttaacaaaagtagacttctatgagttaacagccagaaagagaaaattcattcattaaatatttgtcatatttttgacataatgtatgcactatttagaattccctgaatcaaatacaaatactctgctatatttgttatttgtatcacaaactaatgataaattaaagataaagagaatattgatttgtaagcttcctgatacaaccataatgacaattagatttaatttgtgactggggatcatcattaaatgaaagagtcaccaacagtgcttttctgggtaagcaatgaatggcataattaaaattcaaaatttttacttcattccaggagtttctgtccagcctgggcaacagaggaagaccccgtttctgcaacaaaaatttttttaaatgaaccgggcattgtggcacatgcctgtggtcccagctacttgggaggttgaggtgggtggattacttaagcgtggaatgttgaggctacagtaagctatgattgtgccactgcactcgagcctggacaacagagcaagatcctgcctcaaaacattttaaaaaatttttgtaaaattcaattctaatggagagtttctcaaaatacagaatttgaacaagctgtttctttatatcagaaatttcagaaaataaaacagaaaggacacatccggtattcttaacctaggtcatatgcctaaattccttactgtataaaataaaatatgaatgtatgaagaaagtatatataaaaatggatcttgttagcattgatccaattaatagtattaatagatcagaagagacagctcaagagctttttaaagcttattcagttgctgtgcagacatttctgctgctgataccactatttctgatccgttaactttttatgagtttgtttctgttttcacagcccatcaatcacctaccatccatgtatgctttagggcaaaacatattaaggtcatccactgaatgaaaatgaggtctttgtgttgtaacatctgatcatcgagttttaaatctcttttcctaaaaggtgcaagcataaacactatagttttggttttgtttgcaggtatttttgggccagggaggaggtatgaacagggacagcagacactttaatattgaatatgcaggcagaggggaaggtaatgattggtgcaccaccaatgctaccagtagcatcttctcttacaactttctttgtactgaaaagaaagtgaatttctctaagatcctcaacctctaaattttctttgctgggaaaaagaagaaaaatgaacacatattagtaatttgtttggttttcttatatatcaccatcttttaataatattatgtttattttcatcattttgcccaattctaaaggccatgggccagagggtgtcaaaccttcagtaaaggatttttacagtattttgaaaagtctgtaattgggtctctctatcaaaatggtaaatgtgcctaccctaggaccctgctatcatatttccaggtgtctgacatgcagaaatagcaatgatggtgtcaaaatatatgggctcagtaatgctcattacagtagtatctgtaatagcaaaacatgagtaataacctagcctccattaatagggaatgagttaatacattttgatatctatagaactgactaccatcattgtcattatctgttaaaaagaagacataatacactcacttgaaaaaagtccatttttatatagttaaatgtcacaacagcaaattgtgtgtgtatacatacatgacatacacacagacatccctacctactctatattatatcatttaaataactacatacacaaattaattctggaaaggtatatatgaaactctatatggcagatatttctggagacttaattggagtaatgacacaaaatattttaattttaattttaaatatgtcaaataaaaaagaaaaaaaagtggtggaatgaagagtaatttttcttctctaaaagtgcttttgttggaccgtttcccaccatataattataaaaattttcaaacgtacacaaaattaaagagtaacataatgaacacctaaatggtcacaatctatatgcaatgattgttaacaagcttattttctattttccaaaatttccccaataaacatgttgcttttgaaattaaaaagatgttctgggacggagagactaaagtaatttggaaattgtttataaaagaaagaaagagaaaactttccttgcaaatggggctaacacagttcatctttgtttaacaagcaacatatctattcacccatcctagtgcgcacccagttactgctgtctacagagatgtatggagcttaatggacatttcctttaaatgcatcttttataagtgaatattttcttcccttcttccatagatcttaaagacttgtaaaacttgatcagcagttaataattccagtaaactcctctactacgtcacctctctcttttacttattttgcccatcttattccactatctgttagaattaataagtcaaatcttagctaaatgataccttcctatatacttaagtccccattttaacttggtagttattggtgatacaactgatgttacttaaattgcctttttcacactaattctggctgaccttgtacactaataatgatttattgtttaaatcattattctcttaaatgattaggtagctcatgttgtctcaaatataacttggctatacactgccatctgaaccacaataagacagacacttacaatcaatcatgcaaaatacttacaagctgaggtgcctgctttcaattgtgaaagcatgggcttccccgacctgttcaggtgtttacatacagtgtttcacagactgacaggatattttttttcattttaaagtatactttaataatgaaagtgtacaagcacaaaaaatgataaatgttcccgtatatttgtccagacttaccatgtgaacacatcacttaagtaatagattggtcctaacactatgcagcatcctgggatcctatcagactgtttatcctgaatctagtcctattcctagaaaaactaccatttagggggagaaaaaaaatttattcaacaattccatattgtctctgatgcagcaatcggttaagtcacaattacattatgctcaataagagaaaaataaaatagtttttcagaaggggctgggttggtgattcttttttcactcatcttaatgctaaaaaagaccaagaactttgttgccactaacgaactagtgggcttcagccctgaagtacctctagctgccagcaccatcagtgacttcagaatgagaagatacagcaactccttaaggtgctctgtacagattcaagtccaagctacttctttggaaggctctcagcagtgtcagagagtgacttgattcttgtctaaaagtttgaaaatgtgctaaagcaatgttcctctccacactctccaacctcacaaggatggttatactgacaaaaaagcaggtttctctgtcttttctttgtgccttagctgagcaacggtggatggaaatctaactttttctgatccaactatgtttgtggtactgcatttaagggtacagttctttgacgtacttagattgttggaatgctatatttatatgaaatggggaatatcgggcagaattaaggaaaaaagatctgacttcttaaatctcgattctccaaaagaataaataacttagaatgtaaatcaatctttcattcacaagatgacttttttgagaaagtagaatttatagaatcactgaactaagcaatgtgctttctttaccttctgaaaggcctactgaatttcaaatcgtaatgtttgtttgctattttatcattcataacagacccatcagaagcagaaatcaatttgcctttgggaacaaattctgtactaggtactggttatataaatcacaggcatcttatttcattgaaagacattttttgaacagaaggtgtggattactaattctctacttatgtatattattaataaatattctcaagcgttataatgtttggggataagcaattatacattcatagtagatatattaaaaagccacatttcagagagtgaaatgtaaataatttaaaaacctaaaaattagcgtcatagcacctgtcatgcaacacctaatgaaggattattttatttcattatccaagaaaacccttgattcttcgtgaaaaagaggagaagaacaaccacaaaagggttactgggttaacaaccccacattctgctctcatcctattggcaagtaattatggtaattaacagccgctggctaaaatctatgcaggctgaagcaaatggtcacatctctatgaatttcatattaacagcggagtctatttcctttgtaaaatggtaaaaatgttccagacagcaggccacaacatagagcttggatggcaaataaacaatttcagcaaatcaagcttaagtgaattgcttacctgagctaaagggcataatgtactgcttcctgagtgaacagatgtgctaggaccttaggacaatttctccttttctagtctcctcctctactacagctcctctcttatctcattttgtctactacagctcctctcttatctcattttgtctactttattcccttattcatttgaggtgataagtctaactttagttaaatgacaccttcctttatactcaggtccccattttaattttgtaaagtcattggtgatacaagagatgttacaattgtaacattcattcttctttctggtatcttacctaaaatttaacagattctctctataaatggatataatattcccaaatacattgggaaaattaaattgctaatagaattcttgagtttggccatatttgcaaaattacatctgaaagtgagaagtacttgcagacagaagtctcctggttgaagacattcctattctcttacctgcagtcaccagcacctcttaatcattctctctacacagttcccattcttgctttgtgtttattcccggaaacattttctgttggtgcgagaggaggtgaggtgtagcagcactctcactggctcccttcttttgggggtacccttgcctttctgctcaaccttatactgtgtttctgcctccggtggaagaccaaggttggttccagcacaaatgacatttatgtgaaaaacagaggaaggaggggcagtggagagctagcagcaaggtactgagaaatctgatccgtttttctatttccacaacatgttgctcttttacagggtgatgaggtaagaaatgcaaggaatcatgtagcagatcatttcttcagcttttgggtcctctatacattgagtttgctaaattgaaaggaatataaattcctgggtccattattaagaagttgcctgtaggccaggagtggtggctaatgcctgtaatcccagccctttgggaggctgaggcaggtgagttgctggagcccaggagttggagcccagcttgtgcaacacggccaaactccacctccacaaaaataaaaaaaaaaattgtctggatgtggtggcgtgccccagtagtcccagctacttgggaagctgaggtagggggatcacctgatcccgggaggttgaggctgcagtgagccgtcattgtgctactgcactccagcctggacaatcgagtgagactctgtctcaaaaaacccatcaatcaaacaaacaaccaaaaacaaaaagaagttgcctataggctgaagtagttagtatccacctatttcaaaaagcgctgacccaatgaaatttactacagtaacttaattcatatcaagttgccttaataaagtactgagtaggtgactcaacaagatgcatccagagggctacgacctatcctggaagatgacacaagtttgttcaatcatcatgtacacgttcccggtgcatgatgaaataattttttttaaagtctaacctcatatgagttagaattttttttaaataccgacattatgatgcttgtatagccacactgaaaatgctaaacatttctttcaattgaagagttactagttactatgttacatctacatgtaaaagagaaaatatgctgaacataataaaccatgttcaaaataattcactgtaaaatgtgtactgtaatatatctgcagtgtatcatactgtgaatcagaacatccatatggcacaaagaaacttgtctacaatttgtgggacaacactgcaaccacattttaatcccaaagacttcttagattagcttttcactttgttcattatcataacatattaagatagggtcactcggttttatattttcagctccctctgccattcataatttgccattcatttggtataaacatgctttagttgaaaaagtcaaatagatctaggcatgaataaacaatattgtgcagaaggcccctcagtaggaatagtagtgttcctctgttgaagcacttaatgttctttattttaagaaacaagtatattttttgttatcctcagtcactttatgtttctctctagtaagaagcctgaagtgatcagtgaaatttagtataggtaatatttaaaaatatttacctcattttcctccctccctccctccctttcttccttcctctttcagagtaccataaacacaaacaaaaaggaaaatatagaacaaatctatgctttcccatgggatgaaagatgtgtacagtcatccatttactcattcattcacttgatgagaaactgaattctttccagagtggtgtcattggaaataataaaaacaataatcaaagcccataaaaatggtagatattattataaagactatagttcttccaaaatttgaaggatacccatatttctttttcttccctacccaatttccggtttgcagaaagaacttaatttcctttcagacttttgcttgggcaagtctccataatagtaaaataaaagagcaggatgaacaaaatggctcaaaataaagtgataccttcaactcttaatatcaattgagctgtacaacttctgggaaagactgtgtgtggattagatgtgtgatgcttcttacccggtgtttgaaagttaaggcgcctcagttctacagggtctgttgggtggtgtgaagggatctccttattgttcggtatgctgctttttctagagtcggactctgccctcttcctatagggggaaaatagaaatttaagaagaaaagaaaaatcaattgaaacagatagaaaagcagagaattgcacctgcactccccccacctcccaagttttcagttttacaacttttcaacccagctgacttgtgacccagttcgggttgcttttcccccctggcctaattgttctctcaggtctaaaatttttgtttaagtcaatgatctcgaagtcctcctccaactgcaggattaaataattcagcaactctgccttttggtttcaaagggatcttggtgagatacgcatggacccttattgagcaattctctcttatctactagttctatttgtgaggaacaggataggatacccctaagttgccaatactaagactgttgttaccatagagaaactacctgaccttaagctgaacagctaaatctgtcccccttagccctaagtatatataagtggtgactacagagagtagatgccgtagattttcccataaggcaggtaaacacaagtgcatttttaagatgccaagttatcctaatgcctaggataatcgggaccaggtaaaacagaactcccctttctctttcaaatgtgaaggaaaaaaaacagtgttagctcttaacagtgttaagctaactgtgattaatattttgttaatgaaaggttcacagaaagatcagagaaaaagtaatttcacctggtgggtagatcagcgctcctgataatcattcaaggtgccattgacagtgccttgttataaatgtgattcttcacacaatacattttaactttgttctaaaagctatctactagctttattagatatccccatttaagctctcattatgtaattttaacaaatttctaagcaagaaatgtcagatctgtatataagatttctttatccaataaaaaattaatcacagagtcctaactatcttcttccagtttgaattagattaaaaacccattgaatcaatagaagccattttcaaacagtgctttttttccaaatactaacgcctgcaatctctacaccacagtcacaatcctagtatctcacccctgctcaaagcaaaggcgtttttactgtgggggggaaaaggtgctgcacagtgtttaggaactttccttttctctgttcgatgtgactgtggtacagctcattagtgttgctgtggcaatggggtctcattcaatgccacccaggtcgttctatggttagccagagggctcctgttaaatagcctttcttcccatttctgctcatctgtataaaataaaactaaccagggggtgaagagaagattgatacaaaggggacgtgcacatgatttgctcaagtgcagtgcctttggcaaaacatccttaatggaatacattttcatggctaagtcctattagacatgttgctttctcggtaccttagattaacctgtctgaggatttcttctttctacctaaaggtgtcagatacagccttgggacaaaatgtgctgccaacccattccaccaatcagaggtgagcagtattctgcgacctgccaaggtactggcagctccagttctatggagtagaaaggaagaagaaaagaaaaagaaaagacaaagggctggtgaaaaagatatgaggacgaagaaaaagacaggctcataagaccatgcgaaaggaggacatgatggccagtttcagagtaggcaatgtcactgtgtctgtgctatgggtcttcgcctcaccacactaagagattccttttaccactgaagatgcaaaatcgaaatgggttaatgaaacgtcactgggtgcagccagccagtcaattccacgtgaaacatatggttggtcttctcacttcaaataataccaatggcccttctcatgttttgatcattttgcataagttggcaaggatgcatttctttactaatgtgtcaggcccaacgactaaaatttggatttttctcccttcccattgtggctctgccattcttgcaagattatggaaaccagaattagaaatatctatctgggcaagaaaactactttactcttacaggtattgtagggtaacctccttatcttctttttccctgtggctggggtgagtgacactgagctggagggtagaaaagaaaactctctaaagtaatttagcccatttctctggtgcaaggaaagttaggaattacatcttgttgcaaagatgtgagtctcagaaaactcaagacatgggactaaaattacaattcacaatttgaatgaacagggagggatgtagtgacatttaataactaacttctctttcactgtttattcaaatgaaattatttccaagacctcagactcctgaaatcctagtcaaatagaaaaccagctgcttaaatgtattttgcttagttttctttcgatgatcacaacatggataattctggctgtccacattcttatcacattatttttaaacacttattatgtgatgtgctagaatgattgttttctaacacagaaaccatttctaggaaagatgtggaagatgaagagtttggtcatcattggtaataatactaaagagttttaaaacgttgtcataaaatattaaaagacatataatggtctaaattaggcccaacatgaatgtaactagtaaccttttttcctgataaatttcagaggtctcatcattctcattttcgatttgaaaaatggaaagaataatgaatagaaacagattttaaattttgccttgctctattttttttctattaagattataaaatgttagtgcgagtttatttcttgcagtgagaactatctactatgtggaggagttatgtaggtgaaaaggaaatggaagatcacttgacattttggatctgtcagaaactgctaatactataaaagcatgtggttgtttgggatgtgggtaatacacaatacaaatgctactctggtctacggggtattttgctttcaccaggctctcatctggggggaagaaaaaaacaaagagaagttgagtgaaagatcaattcatggtcttgaaacaaagatatacagacatgtgagaagaggcttttgaaagaaacatatacttattagaaatatctaccatcaatattcaagtaaatcaatcaaaatatttgtttctgttaacattaagaatgtaatcccaactctgccactactggtatgtgtcaactacaaattttcttttcagtttatttgtgtataaaatagagggagattagaagaggatgtctaagttttggttcaactctctcattttaatagaaaaagaaagcattaagttgtaaaatatgaaaagtgttatgatgaaaggtacggagtcccactctgtcgcccaggctggagtgcagtggtgcgatctcggctcactgcaagctctgcctcccgggttcatgccattctcctgcctcagcctcccgagtagctgggattacaggcgcccgccaccatgcctggctaattttttgtattttttagtagagatgtggtttcgccgtgttagtcaggatggtctcgatctcctgaccttgtgatccacccgcctcagcctcccagagtgctgggattacaggcgtgagccaccatgcctggccgatgaaaggtagtattttaagtgagtttaaagtgttttgtcttttggctgaaaaaacaaaaacaaactattttgcacgtgtttttctgctggacaaatggatactagagatgtccacacaaagaagacaccctcatagaggtttaaagattcttatcattgaacatgaggcttgctgaccaacataaagtgattttagtgtaaataatgcagcaatagttctcaaactttagtatgcatcagcatcacctgggaaggcttgttaaaatacagcctggtgggccaatgcctagactttctgatttagtaggtctgaggcggggtccaagggtgtgtatttccgtcaagttccctggtggtgctgacgctatggctgctggtccagaggccactcaatggaaaccactggaatatggcattgggagaaaggtaggtgatcttcaagatgttttttgtagtttaattttaatcgggaatttatatatatgttacatgtgtatatttatacataagtgtatatgaatatatagatatgagttagaaagctagagggttagtttggattaatcattcaataatcacatagtgtattttagctattattattgctcttattattcaagactgggagacatggataataattttgaattggggaagagttctcactaaggcactgtcatcaatatttgcaggatgtgaaaatgctaatatcattaggtgatctgtactcaaacttgaaaactaatctttggtaaaaacaaacaaaacaaaacaaaacagtttatgagacacctcacatgtctgctctgtaaacacatcaacacacacaaatgcccattttaatcttgaccacaaacaaaactcagatattggtttgtgtactatcttttaaacttcgcctttaatctgtttttttctaatgtaaacaaaatatttattttccccagaatcatcttaatgaagttactgtgtatatgtaggctttgcccatcttccacgtgccaggtattatcttttgtgtgcagccccgccctcccctcttcaacaactctgaagtctaccagtttatttttttcttactgaacattaaaggggtttgttctctattcctcacctgtcgggtttactgctccattttaatgcagcaaaaaaaggaaaaagaaaggctaaatgttagttggccaatggtaacaaggataaccatgacaaccaagatttaagaaatagtgttcacaagcaaggacacataactgacatacattcagaagcgacagcgaatcaaaatatttatagacctctgattatgaactaaacagaggacatgaagttacatcactgaatacatagtgtgtgtgtgtgtgtgtgtgtgtgtgtgtgtgtgtgaatgccacgtgcacttttatccatcacctataaaatactgccacaattaattatatcccaggaagtgttcgacagtggagagataatttgatttttaaaaaacatgctatgagaaaactaatgtactcaatgggaatacagcatcattccataaaagaaattcgttcatttaaaataaaaagccttcaattaagaggtatgtcattcctttcatgatataaaatatctgcaaattgtattgaactatacagaaatttgcacaattgaataatacaccaaaaggtaataaggtggcagaaatgatttcttcaaacacctcttgccacatcttttttcccatgaaggattaagtgcatcttcagtttaggaaaatataatacccatcattataaatctacagagcatggcccatttatacagttgggctaatccagaaaaacattttattaccagccattgacagaacatgtattttcctagtctgtggtgctgtctgtgaacacaactagttcatgcttatagatcctttcacctgtgataatatgttgattgtgtaaataaccatattatttctgcagagtataaccttttcctgaaaacaattaatctaaaaatcttcactttgaggcaaattgcaaagttttcagtgagttcccagttgcaaaataaaggtactaagtttttcttaatgccaatgaaatatatacccaagtggctggaatatctggccctgtgagataattcaatccatctcttttcaaaaataaaaaaatccacatttaaatggtacaaacacacacatacaaagtaaatgatgaaaatgatatcaaacacattggttaattcttcttattcttaattttatagtgatttacgtagtgtgccaggttaaaaagaattctatataaatgtttccaatttgctcactttttaaaatcagtgactttatcagggaatcagttgtagaaaaatctatgcctcaggatggaaaaccatctagtgaattatcagttctatgtattaaaaggctgttttgagtattcatatgcacaaattcatagttccagataaaggtcagcctcaccatacacctgggtacatatgtggtacaaatatctaagtttgaaagctttcacaactggtaaatttaaattataggccgaggattttattgcaactcttgccagccaaaataaagttgatattgagtgatggagtcaacatgtagaaggaattgagtttgtttaatactgtttgacttgtatacatttaattattcaatatttttgtgtgccaggcactctactaggcagtagcaacacaataatgaataagacagagtccttgacctgcagtttagtggaggcaaagtgccaagaaaaggggcattgacagtaacgcagtaggttctacaacagacaagtagaaagtactttaagagctcaggaaaagtgatcctaaagcagcccgaactgctagagaggggaggagaagagaggacagaaaatgaggcaggcacccagaaaggcttgatttagtaggtagcatcctagcttacttccaaaggatgagttggagttatccaagccaaaaggagtggcaggggagtgacaggaaaggcattcctaacctagggagggcctactcagaagccagaaagcagagtcaaccagcagcttccagtatggttgggtgtggccacatatttcttcatagcatctcaaaatattctggactgcatttccttgatgagggcttggaactgtatggagggttgatacagaaagagaagactaaagacacaaagcttgcagagagccagtgttggagcaggaaaaggctggaaaaactgaagcctacatttcagtctcatctagctcatggtttccacatcctgggatggggatggaaaaatagtgtgcatgcaggctagattattaccattcaaggatgttaattttgcctgaagtgcatctcagacttctaggaccacctgatctacactttctttgattccatagtatgtaataaacactttttatccatcttgaaatgcttttccatagaggtaaggttaacagtttatttttaaatgtttattttttatataaataattcttggacagttctggaataaagtctgaaaagccttacatatgtaacagatatacagaataagaactttcaattgccttgtgaattttttgttggagtagatggacgtgcagtaccaatactattatctggtgtttaatgttttcagattatagcgcattatgattaaaaaggtctaattatctggtccacccactaactttgtaatgaagaaatgtaggctcagagtgttggcatgaatttctaccccatgcaaccagctagtcacagaactgggacttggattcgggtttcttggctcctcagtccagtacttggccgaacgttgctactatcttatctctggaatgtgtattttaagtcatgggccatataatattttttcaaaattatagtacaagaaaatttataacattaaagatataccaaatatattttaattttctgatgattcagagggtattttagggatcttaccaagccctggtgatttttttttgttactgattatcaatgtattataggtatacagattactagattaaaaacaaaagttaaatgaacagaatgccagatcaaagagtatgccatttccacatgaatagatctaataggaataagtctcaaagtctcctcagacagctgggtaaaatatacttctttatatgataaaactatctgtagctacagacctattgctaatgctagcatcttagaagcagagatatatgataaagtggattatcaatataatgtgagtcaacaacgttttattctcattctcttctcaaagcagtatttgcatatgggaagtaaaatattctgacaataataataataataatactttcaattctgagtcattaccaatgacctgtatataaactgaaaggcacctaaaaagagggaatggactatttattatgtaattaactttgctcagaatccaagctataaaagacactattcattgggtacagaagatttccttttgaactgcctcatgataatcaagaaggacattgttggttctacttgaatttcaagtcaggaatgttctttactgctgaagcaagcatttctatttcagaaatgcttcatgggccttcagatggttagctaaatatacttagcattcgaggatgtgtgcatttcccaacaattgcattagacgatgcttacataggcccacactaaaatgctactctattttaacagagtcataaaacctttaaatatgatacttctttttgtgggattaggaaaaattataagtgagttgattttttaagcacttgcagatgaaggaagaaaatagttatcttttaaaaattattagggctataatcatatttcttcaaatttacatgactgattcacaaataccatatacatctgttgcttggtatgatttaatgatagctatgtatatccaaataaaacataacttaaaaataaggcattaatttttcccatttcaaataatcacaaaatgtcatgtcatatggtctagaaatacacctgtcaacaatcccttgttttttgacctactcccatagtagtatgtgactacctaaatcaatatttcccagaaaacaattagaattataccactgctttttattattgaattctcttctggaaaaaagtgcagcgtacagacagcaaaggacaccagctcctgcttggactcaaacagggtctatgattactcacggggcaggtgtgtacctcatgcttcctgcccttatctcttacatggagagaggtaataaaatacaatgggttccttaagatacatgcttatagatacagattggaatggaagattcaaatcatcaaatgagaggagattttggctttccacacttactttttcagctattttacagcacggataattgaatgatggcagtgttcatgaaaaaaaataatgatggatatatctttcattctttataactctaaaataggataggcaatttaatgggttatggttatgaacttctttcatttgtcctttattttctcaaccctctcttaatgctggaataaaatgaaatggagccttttaaaaacaagtttttcaaaagagaagagttttgaaggagtttctttttttaagagtcaagataagaggttatgggggaaaaacgttattccagggacagaagagcaagggagtgagggtgaaaataattaatataaaccccccaaaagggagctagatgggtaggaaaaagagtgaatggaaatgagattattagattaagcatgtaagcaagaatcaaaatgaagatactctttttagattctgaaggccaaggttagggacagggagagaagctatcttgtagtagaaggatgagatcaacttcacagtagcatttcaaaatataacacaccacaaggaaaacgagaacatggattaaagttttgtgaaaatacaatttggattggaaaaaaataaaaatctatataaagggaagtaattttgaatttagtcattttaaatgtttaagaaagtatattatatgctactctttataagttcatatttatattataattatattcttaagacagaaagaatttataagaacaattactaatgtcctctatctaactgactggccagtgccctaggggaaaaaatcttattagagattagatgttagaggcagaaataaaattgaaaaagagtggcatatcagaaaaatgtgggtagacacagattatttgcatcctaactgtagtcaaagacactactcaaatcaacacatgggcataataagactgagattatattttttaaaaaaggaaaatagtaccttggcatccctttttggacacatacacgaattcaccagtgcagatgtggaataagagttagaagaaaattgggagacgattcattctccatccttctcttttttttccccttccttaatccttaatttttatctgcttttgctaaattttgagaaatagctacagggagctatctcaacacttgcgcaaattagaattatgatatgtatacaaattgcaaaatcgtgatagtgtttcaaaaaacacactgaaatcgagcaattaattatctaaaacaatcaaatgaaagcttgcatggaattatttgcttgtgaatgcactaatgcctcaattgttatgaaaagtgcttatctgcataaagcagctcagaagattggaggccagaatagatgcatgttggacaacagaagtctataccaaaactgaataagattccaaatagtacagtctttacattttgatcttactgtaatgtaaacacttttccaaaaataattgaaatggcactgaagtatttctactaaaatcaaccacctaaggacagcagaacaatgatcaagtcttcaaaaataaggcagcctccaaaattacaacagaaatattgggcaaacctaccttttataaagaagaatagcaatgacaatgcagatgataaagaccactgcaaggacaggacctacaacccagatcaagccttcttcttcatccgtgattggctgcggatccagatccattgacaccacggggtcggagtaagggctggttgcatacatcttctgaggaaaagcagagtctatttcagttataaaataatgactttctagataagtacctttaacattagaagaagcaaaaaatccaggaaatagtggatttaatgataagtgtgtgatgcaatattagcaaaacagaggggaggggagaggagaataaagaaaagaaaggatggaagatgttttgtaatacaaatttccttatagagtgaactattttataataaaatcattttgatagtacaaattacttcatagacactttttattgggctttctatatggtgtattaaatgatcctatgaagcgtaaagtaccagtaattaaccagttgcaaaatgtttaatgaacatttacattgtgccaaggcgttaggtgctgtgtgaaaatcaagagaaaaactagagttctagccctcaagccattatcatacagttaaggagaccaaagtacatatttacaatgcaaaataagtcagtatttaattaaatgtgaatatcggtagtcattagtactactgtgcttcttagtgcttggtactacttaatactactgcatattagttaggaaatggaggccaaagcatgaacaaataaagtctacaatttcaaaagagaattccacagttcaaattacagatgcgagatgtacagaattgatgatatggctttataaaatatagaatttttagaacttaaaagaattcagcagttctcacttagttttattacagttattgctcagagattggtatgtttgttctcaatagacaactgataatatactttttaagaatacagttacttggagaagaaatggactaaatatcgatgatttttatttctatgatatccgatcccatttagttctgtcctattttagcctatattaggaaaacatcttcttggctctacctgcccccttcaaggccctatcttccactttccaatccaacagaaactaatccatatccactaactgccctgcttctaccactcactcctcatctcttctcactccaaaccaccattggtcctatttttttttttttcatttgccaaatctaattgcctttatttactctttacctttctagacaatttttccagatttgccttctttaaaacttttatctctggctctctcaattttgaattaaaccagtcccatcctcatctttccaactgctcatgccctgctgagttaattatctctgactccatcctatagacaaacattctttttttaaaaaaattttttttatagagatggggtctcaccatgtttcccaggctggtctcgaactcctggtctcaaacaatcctccagccttggcctcccaaagttctgagattataggtatgagccactgtggctggccctgaacccgtattcttaagttctattctctactagcatctcttgtcctctcttatctggcaaggtcagcccaagctttaactatcaacctccatgcagaatctgtctcttcattaatgttcctaaactcagatactctatgaaatcccagatcttcatttccaatcatttctagagacccctacatatatgttcaaattagtatgagtttcttaatttttcccagatccttcttcccttcctcctcacttcccaaattctctcatcctctcagtatctaagaatggatactgattttaccttacagaaaaaaggaatagaatggaaacactgatattagctaatcagtgtcccccaggtccatctgctcttcttctagtctcatgagtgccacttttctttaggcccttacttatgtgctcctaactataccaagagcttcttccttcctctcatagtctccactgctgctagaggtatcatcctaaactgcaactataaagccttcaagaggctctctcttgattcccaaataaaacgtagataacttagcatggttctcaagggcatccacaattttactttaaacttgcttacgacacacaacacattccatcacagtgggcttcttgctactactccctaaaggctctattcttgttcctcaactccctcacaagttccacaacatttagctcctgaaattgaacaactctccaggcccccacttgaatactgcctccaatgaaaccacctctttttaattgactggcagtgatcggtcattcccctctactaaaaaaaccaaaaaagataaaaataacacagctaaatttttatttagtccttgtttttttaaatggtactcaccaaactgtattttggctttttatttgtatatatacttcattttctttggcgaaactacagactcctagaaggtagggatttatatattatttgtgtttatatgcttaaagcagctagcaatgaaccttgtacttagtgggttctcagcaaatcttggctgaataagacaaaaaatgttcatcttttcaaatggctgaaattgtcaagacatcagtatatatgctcacttttcatgattggtacatatatttaaatgttttaacctgcatctttaaaaaatttagtttatggcatctattctgaatttaagtacaatgagcttggccatcaagcaggagaacagatgttccactgaatgcttgtatactactcttctctctcattttcgtcattgtgcccaggaaagagactgactagatttgcagattttctaacgcattacaagaagataaaaactcagtatatatgtccaagcttctcagaggcagccaaaaaaaaaaaaaaaaaaaaaaaaaagatgtgtatggtatgaggattgacacaaaggacttggcaaagaactatatatctaagaaacatgattttttatataattgttttggtttatgctttacccactccattttgtaggtgatgttaaaacagtttcatagacagaactaggcaatactgtctcatttgaaattctttaccaagaacctttaagataataatcacggtccattgagatggaagtctaagcacaggttttcccaaagaacatagatttccaacccattcaagaaacagagacatatgaaaatgaaaagaaaacaaaatcataaaatgataccagcctaatgaaaaatataatttcttgtgcgtggcaataagagattaaattttggataattccaaaccagttatctgacattcttaatatgagacaaaggattaggggatagcttgtgtctttgagagggacggagaagtattttctctttgcaaattaccagtctacccttggaacattgttataaactgatatggaaatttgaggcttacacaaaggctttattactgcaaaatgactctagctggatacaagtctctcctaggcctgcaaatatttatgatatataaagaaaataaatatcatagatatttgaaagcaatgctgagaaagatgatagaataaaggggcaacttcattaacaaatttggaaaaaattcttgattctgtaattaataaacagatgacatactaaagaaaggggcagactctttatcagttgtgacacatttaaaacactagcggaagacatcagaaaccacagtgtgtagttcagtggttcagtctgcaggatcgaatgagatttctcttctttgctagattctctgatctacctcaatgctctaagtatgctttttgaaatgttcctagagctattaaaagaaatttcctctcaaatatttaaaagtcatttttgaataaaagaaaaagatgatttcttaacattccattcccttgatgttctgccttaaaaccttcaactagaaagagaaagcatatctgaacattaaaattccaggaaggccattactttgttttcaaatgacattctgagcacaaaggtaaaccaggcagagaggctgcctttgtgttttgattttccacgggggaattctttcagtcacttgaagagaggccccactgtacacactaacacctgatgtggagaaatctttgatacattgtgagctgcttctatatgggaaatgactggctcaactgggttgccacacctgtcatatttagacaccgattagaaaacgaagtttataatatgtatattaaatgttcatgtgtactgccacttcaaaattcaccccctgcctatctacaatatctctcccctttttttttttaaacattcaaagtaactgaagcataaaatgacatataagcaagatggattacataaaagaagaaaactcattatttagaataccttaggaattctctcttttattaaattattttctaactttcttggcttttcactgatacagtcactcataaatttctacaattaaagaggctgctgtatttgcctctttctagatagaccttcctcatgaatccgggtagaggcactgtggtctcacttggcagatataggagaataaatacaatcacccccaaagtcagtattttcagaaatatgccatgttgaatggccaagcttgtgagttcccattgcaatcacaggggctaatgtcaaccaggtattatgcaacagtctccttttttggacaacagtcattttgaaaggatgatggaaggagattgtaagcaatgatggttctaacaccatgatatttgtgttacatcagaaggtatcaagaaccatgtcctatcgatctggaacttcataaactagagggccacctaaatttccttcatcagagacatagtctcatttgtaatgcagtctcaaggagtatattgagcaatgttcaaagagtaggcagcctgttattacacttaataacagttcatgagaaataatgaggatggatatacccacaaatccccaaataaccacattccagtgaaaatgtataagcgtaccataggaaacagatgccatcataattaacttacagactctgcatgttccattactgctaacacaaagaagacatattcttgaccactttggagttgcttgtttgtaaatccaccataatgcttgtcatcccccagggtgaactcagtgggaaggacatcaaagtgagcggcaatatatggctttaattcaacttctctcccataacggatgcttctgcgcttcctagatatctccttaagcagcttaaggaaaaaagtgggaaacagaaaaagaactgtaaataataacccagcttattgataatttaatgagataaattaattcagaactgggaacaacccaaatgcaatttgttcacatttcatatagcacatcagcatcactaaatctcagttctctcaatatttcaaatgcttctcttcctgttaaggtagaggtaagatactggactgctctgacaaggtctaggctataaacacagggcaatgaggtcctttgctgtagctcatttcatttcctacactaatgaaattctctcaaagtgcatcataacttgtctaaggaaaaaagtcagcttgattcataaaagccttgccctgcaggagatttattaaataagtattaacctcagacaaagccatctaaatctttaaatatagccacattttagaagaggttagtgccactttagattgttttgagtaatgagataactcatatgatacaaattccctcaaatcagcagaagcagaatccaataaacaatttttaatatacacatattaaatagacattgttactcatttaccaatttctgacttgacttagctccctggttaggcaattagggtgcacttccttacactttatcatggagtcaactttttctagaattgacctctcttgggagtgtgtatatattgccagataatataggcaaggtagatgaaaattaattttagtactgccctgaagaaaacacacatgcacatgtatatacagatgcttcatgtatttctaaagaaaagagatagagtttatttctggataacctattatttttcattgactccttcattacgagaaaatcatactaacagtggttatgaacactgatttcaaagttacctttgacttctccaattaaaattggtatttcacagggtttaacaagggaaaggtctgtattagtctgggatgcctgttgatgtaagcagcagtcttttcgccattttcttgggaagaatttttattttatttattttaatatctatgtattaatagaaaagtctatgtatttgaggacaaactggaaaaaggaatgaaccttgtcttcaccttgataaacaaaattaagatacttatggaaacagtgcagcaaaactatttactagccctgtttttgtaaatagaaatgatctagtaagaaccaaagtgtgatctctacttagtagaatgagagcctggcatgatcaaggctaggcttctgtgataaaatggcttcagactgtatatatgataaacactgaattcttccattaggaatttgatcgtacgttacagtccctcctacactgggagtagtaaatgtgttcagctggttcaaaattgtatcctaaaaatgtaaaaaaccagtttttcagttacaggaaaattttggccgacattatttttcaataatatttaatttataacgtgctaaaattttctgtgaatttaagtttattgatgcaattaaaattacatgaaatgtaagctgttttaggaaaaccacggtagattgggcatcacttgtttagcaaaattggaccatcccataataaattcagttatgctgatcaattatgcaccaattggccagtaaaaacacaaggccagaaaggtagcactatcttttaatcttgttgtcaaatttagctttacttataatactgataattataacaataatagttttcatttattaagcaattactgagtgccagacactgttctagggatcctaaacatgcattagctccaatttactcctcgtaataaccctataaggatggctaatattatcctcattttataaatgaggaaactgaggcacaatagaagaaagtctcaatatataattagactcaattactgaaataaaatgaaattccatgttagagattttttcaactataatgtaatttacttaatgattacacaatatcataaggaaatataatgtttaagctctgatactctaaattgttctaactctgtgtatttatacatataatttttatgtatctgcttacatcaaggcagatgaatgtattatttcttttttcttgattcttttcatatgctaattaaaaaaaatccgataccaaatatttaatgaagtattataattgaagcatcattacacagcttattgttgatatgtagttaaggacagtagcctattacaccaagaaggaaaatgcactgcagaggtgctgaacagtttttgaagctgggtaatcaaaaacattcatcatgagttgtttatgtgactgtgtcccctcttctacttcactgatcaaaccctaccttggttttattcatactgcagatgtagttaatagtcgcaattcatccatatcattgtcattcccacaagcactttctgctagggtttctttagaagacttataggaagtaattcacaataaaatatttgagcttttgggtattcttagacccaatgcagtcattcattaaagtcaaacctggagcatcactctgcccctttaggttgctctaatctctgcaggatgcttcctgtgttacacgttaaatggttcaaatgggctcagatgacaccaaagtcagccagcatgttgcagttacaaccacaaatgaccacattattttacaacaagcctttgaagtacaatgcagtgaaaagctcatgatctattacatgacctgctctgaattaaatatcactaacattctgggagtcattctgccccaaattcattttgactatcaatgtctgctctacccagtttgaccttgacaataggagtttcagtttataaatgtatcatgtggagagcagcccggtaacaaaggataaatgaactcagaagataattttgagagtaatgctgtttggaaagcctctttcaatttcttatgggcctagatatgaggtatacgtgtggaaatccccttaggccaccattctattcaatgatatggttccaacaatttgaattataggcctttctgaaaaattacttgatcaaatacatttaagagaggaacactgctttgtcaaacctggcagtatcaagctatagataaaattactacagtgcttttattatccatggtagaaaaaaaaaaaaaaaaaaactctctgtagggatcaaaaactggatgagtaagcataaagtgaggccatagcctactttcatttgttcccctccacaatggttacaagatgtactggaggtaattccagaagatatatcaagggctttagttctttatcagaaataattttcattttccagtcaatgcatatcttatttcttccaccattaattctacaatgtggtctcaattatatcagtaagaaaagtgggaaacaacccatcccgacccaaaaattttgaattaataaaatgttctttatcaaaccattatacagattaatgcaccacaacttggatgattaaaatgaccctttgttatgggaatcagcagcggagacccacagaatttaattgcaagaaagttcaaagtcatatagccctatactttaatccattagtgttgctgtgcattttggaggttaaaacctggctacaaaagagaatcactttctattacttactaccaaacggctttacttctaaggaaagcttattagttaaaactatttgatgtcattctggcttggatctcagtgccttaaaaacttttttttaataggtagaacaattcatagattctacaagttgcctttgcattttaaattccatttcaacttaaacaggatgatgacacttctgtagttcagctgagaaccaattaaaatagtaaagaatatatcaagattaattgattagtcagttgcaagtaaaatcatgtttggcttcaaaatgcttagaaaagagcagctgatcattctgcattttcagttaaaggattactattttctgaatatcacagaataatgattttgttccttcaccatcaaaacaaaacaattaaattataacatatctaaattacttgatgacattattgaaataatgtctcattttacacagctccaatgatcatctaatcactagtgacacaaaagcataggcctaaccttgaactcatctcctcgtctgaacacgatcaaatttaattcagataaatgaagccagtgatcataaatcccgcttctagagatgacacacgtctgccaaagaaagctaacaacctttctggtcagatcacagtctcctttgtgcagacatagatatgaaataagcatcatctctctgtaatgtaggtagggaatttattcttttccttgctctgtttgtactaatttgaggtagaagaaatacctagaaataaaagattgtactacaagatgtggcctatgctataaataatcccaataaattaaaatctcatatttgccaaatgggggcgttacggttatttgccttatgaactgattgaaaacagcatcatgttaaaataacaaaggctcttctgtattttaaaatgtgaattctactcattaacttgctgtggtcctctggggatctagctcaacacttctggatcatattttcttgcctaaatagaagtatgtagtaattatgtcttgttcttcatgttatgcattacctttcaaaaatgtccttatacaagaagagtaccaattataatgcacctgctgttgcaagattttggaaatccacgttatatatttagtatttgttgtttcttattctatatattctgctttgctcacaattttgtcatttgttttctctatagttaaatgcatttttgactctgaaaacctacagaatatagaacaaggcaaacatctgataatcaacagaattctgtgagaaactggttaagaccatatcgtaggtcaaatgaactctgctgcaaattgcaacttggtgtttgtgacagcctcagcaactgttgcactaatgaaggggaccttgggatttataccaatggtgattaagtctttgctgacaattcacttcaccttccacacctctacatcatgttttacaaggagcaaggggcaaaatgttaaggccaacaaagattagacaggttgtaagctttattgcagcttaatgttttttaattaaagccaaaggatctttgttgggatccccaggggttagcatgcccatagcactgaaccatccaaccagctaggtatggagaagccagcacccagattagatcctgaaaggcctccaagggaggggggcggaaatgcagcagattaaataacgaataaaagacatggccaacaatgacacagttacctcatctaattccatttcatctggactctcccatggcttgataaatttcccgcgagatttcttcaaaggcacaattattatgtagtaacctctgcacaagaatgaatagataaaagttaggttagttgaaaggaggaaaacgtggatatacccttaaaccttccacagaccaatgaggttgaaggcaaattatggatatggggtgacttgtccatttcttacatcaatgacaaatatccacctgtttgttcaattttaaaaacaacacgggaagacatttatgtgtgattgcagtgatcttgtatggtaatatcatcatggtggactgctctttattaggtatcataaacagagcaggcatagtttgttagggccctggtgctggacacatacaaggctagaatactgcaatctaccaccacaagctgctgaaccaaatattttctatgacatgaatttataagaagatgtttttaaaaggaggatatagatgaaaaatttcactcttagcccacataaatacctagtagtgctgttgtttatacaaacctaaaatgctttttatttgaattaaaaatttttaagtaacaaaaattaggtataattgcacagagtaagatattaaaaattcccttctttttctacccatcaaattgcaaatctcgaggtaagtaccgcagaaaattggagaaaatcacgacttaagggccttcaaaacagctatcactataatgacatctatacgaaaagacaaaagtaactgaatacttacactgagaacagtcaactaaaatttaaggaatgtataaaggcacccatccacaaataggtatgggttatttgtaaagctgttttgtcacttcagtctagtatatactctgctttcatattcctgtttagggattctgctcatactgatctttagtagtaactatacaaggactttgaacatactgtttaataataacatattaatcacttcctacttctcaggtattatagtaaatgcataatctggttttgtcctcctacagagaaattctctgagcaaagcctaggtatagcctataaggctacaaggactggtcacaggcaaaaagacagatctgtagagattaaataattgccaaattaaaacagatagtaatgggacgcaaagctacatttatcttaatggtggcagtggtctgtctctttttcttatttactctatgtgtcataaagtattttctaaggactccatacacttcgtggagatttactgtgaaaatgaaaacacacacacacggacctaaacatacccccatacctttaaaagaggaggccaccacacaggacaaagaaacaagaggaaggacactcccaaccctgtgtcacactgaatcacagagaccaatcacagagaccacagaggccagcaaggcctctttctattcatctcaaagcaaaacctgtaataaactcagtaaactctctgtgattaagaactctgtttccattaagagtctagagcagagctgttcagcatggtatccactagcccctgggggccatcgggcactgccaatgtcactagcccaaactgggacgcactgtaaatgtaaaagacatattgcatttcaaagacttagcattaaaaagagtgtgaaatatctcagtaataatttttaaaataatgatacattataaaataatctggatgtattaggttaaataaaataaattattaaaattaatttcacctgctttttattttttcactgttgctactagaaaacttaaaatgtcacatgtgactttcattatatttgctggacggcactgctctagagcattctggtgaagaatatggcacttggagatatgtctggctgggagtttgggctgatctttggcttagaccccagaatctgttatatattctgaaatacgtgagtaaaaaataccaggctgtgatatggggggaaataaaccagaggtgctcagcacagtgtgtgtggcatgtagcagtaaacagataccagctgctactggctagtatgaacatcacaggccggagagacgcatctgaactatcttattcagtaagactgcatgaaattccgtgagctgcaggttaaagagcttgtcaaacttcttttcccctaatggagaattcaactcaaaccagacaactataccacaatgctttctccatggtgccctgagcaactaatcaacagatacacaggattacaccagctagccattcattttctttactacaaacaatcataatgatcaaggaggatgaggagaaggcagaggcttctctgcgtatgacagagaccaatatcttttatgttatgatccagagtaagcttccccctctcctgtcctcccaccatctgaaggatttaccgaacaagtccatcatgttaaatgagcatggaggagaatgacagaggctgcaactgagcgtacaaaatcacactgcagatgtgcttgataaacacacttgtcaaggaacctcttgcttttcactaccaacttctcaaagtcagaagagcgctacacataaagcaatgatactgcatattatcagagtgctaccattgtcctccttcagaatcttgtaaatcaaggttaagctgatgagtttcattaattttttcttctgctttcatactttgagttgccattcttgtacatgaaaaaaaaaatccattctttcttcggcagcactcccccactattcattttacttgtggctgggataagaattgaacagcctcccccacggcaattaattaacggtgcggcaagatatccacaaccttttttctccgctgatctctaaagcattcatctagggcagtcaaagtgaagcttgcttcaaagcagctcttgcacattgaaagaaatagggcagtggcaatttgaaattctgtatcatacaaagcctcacctcagtctaaatccacacatttcaactgtgctctctgcaactatagctttgtaaatatcaacttccttgccttacccgcaacctgtctctcccctgagggtactgcttcctttgcagccttctcatatggcagctgtggatctatccctcctcccctgcccatgaacctcagagtcagggtttggggtttctttcctggcttcccatcgcttcctgcaggtatttttcttccactctcttgcttttgtagtaacaaaccccttcttttttgaagttcatgcaatccagctacattatgatcttctctggctgatttttgccatctagtacctcccccagcatctcctttctctcagggaagattcttttgcggggttcatggccttcttttttctccaaactctgtcatcatcctgggtgatttcaaccttcataggtcgggcccacgtaccactgaagctctcagattcttcaattctccctttccaaagcccgtctcctccactctaccttagctgaaatctacgcttgccattctctgtgccagaatccagggagctgaacacagcttgagaaataaagcacagggcagaataatgccataaattcataatcagcaaccccagttaggccttcaacacggcctggcaatcttaccactatctagtttcctaataactgctccaattgcctagtccttccattttccacagtaacattttcactttctcctctagcctgaaaccctggacgttcaaaccaccccactagaagatggcctcatctcttatataaagagaaaatgcaaagattcagacaagaattccctcatcatctgtctaccaaagtacaagtctatctagatctgtaaacaaaccacacattttcttttggtaaagtagaagggctggccctacttttgaaggccattaactatttcttgaattgttttcaatcttctcactttcttaggaagtttaccatacattgtactccttctctctcatatatctcaacttctccttccccatttgatcccatcacttaggtttcaaccatgtacaaatatgtgtcatatagagaacaaaacaaaccacatcccactctagtcacctctctttctcccactcctgactgccaaaattctgcaaatagctgtgtgttcctgctgctcccactgcctccctttcccttcacttcccagctgactaggctttagcgcctgcctcctcactccacctcactgccattgccagggtgctcagtgatctccagggcattacatcaaaaggggagtttctggtactcttctgtccttcttgccctcttagcagaccttttaagatgttaacactctccatgaaacattctgagccctttctctgtgatattcttctgttatttctatgtatatctccttccacactaaccttatttccttagcagaatttatcatctgcggcccagctacaatggtgacactcctcaaggctctggccaagaacttctatccagaccctattttcatcctagatctcattccacctcagggcatcagttcttagctatatgcaaatgatttccagactcatatctttagccaagaatgttcttctgaattccactggtttatctgactttaagttacaaaagtacccccaatttactgtggttaaaataaaagaaataatatgcctttcaaaataaaccctccctaacattgcactacaatccatttcagtgcacaagccagaaacctaggtgttatcattgacaatctgcctttattctctccctctgtcatacttaatctattgctaagttctatcacttccaaaccctatctccagtgcacgtgcttttctccatctctactgccactcttctggcctcattccatgtcttatgcccagactgtgaccttactctctcaactctctctattgactttagccccgtctagtgcagtctctgaaattttcaattcacaatacaaaatttgttctgccatttccactttttaaaacatttcaatggatcctcatttctcttaggataaagactgaaaggtatcagaaggccagcaggatcttgcctgaatccctctgactgtgccctctcagctacagcttgataggctttcagtttcttgcatttaccctagtccagtggttccgagcctttttggcaccaaggactgattttatggaagaaaatttttccacggacagggtggggattggggggatggttttgagatgaaactgttccacctcagatcatcaggcattagattctcataaagagccggcaacctaaatccctcacatgtgcagttcacaatagggttcatgttcctgagagattctaatgccaccactgatctgacaggaggcggagctcgctccagtggtaatgctccctccccactgcttacctcctgctgtgtggtcgggttcctaacaaggttaggaattggcacccattcatggcccaggggttggagatctctgacagtccattctgtcattaaactatcgatcattctgttccacctgcctagaactttctgtcactcccacctagttaactattctctctccttaaatatctactaactgattattttctaagtgaaatcttctctgattttttttaaacctattacccccattatatggtctctatgaaccatttttaatctatacattttcttatacaacaaatttatatatttataaaaacattactaaagcagacatacatataatacccccaacatttgcttaactttgctattttatcatggaattattcttccactgtaaagaaagtgggtacaagaggtggctcttaggaattaatgcctctcctaagtcaggcagtcaaaaatatttggcggttcttctccatcagaattttcaactctcagtctcatcaagctttttctcctttcttcaaaccagcaatggcatgcccaaatagagtttctagaaaatataactccttattgcaaacgttcttttctttactggcctactcgtgacccttgttctaatctcacaggacattaagaaagataagatgattcatattggaggagtgaaatgggcagctaatatgtgccctacaaattcatatcaaccaaatcatatgagctgaaagaacttgcttgaaatgaaaaaaaaaaaaataaattgcttttggagctagctttatatatgggtaaaattaaactcaatattctgctttgcccgtctgcctcaagcctggagtttagactcaaaacagcttttcaacatagactttaactattaaagtaatagaaaaataaataacttcagaatcaatatatctggaaagcccttgactacttataaagtaagctgtgttttcccagtatattagatttaattagataagttaaatctaaccttcagagttttaattatattaagtaaagttttactgatttcatttaatatgttatcatcaaggggcccagttccccataattatatgagaaggcaagctctggtttttgtggcagtcccacttcaaattcagtcaggctttttgtgttagtgtgtattagcattctcaaacatgttatttaactgggaggtgaaaagtccgtctaggagtttaatgatgaatgtcattccttgcgtaagcctcctggctttaccgctccttaaattctcatggcaacccactgactttattgcttcatgacactaaacacacacttctgtgatctgtacccaagcacatatgcctggtcactcttagttctaaggtttgtctggggcagtcctgtttatgtctacttcttttggagttttaatcagttatcaattgacctaggaaaaaaaaaaattctattttgaccaataaacttatgggcacagaggcagggctgtggttcagaacataggctctggagccagactgcctggattcaagcctttcctctctggttttgtattgccagctggggcaagtcactgtatgttgtgtgttcctcagctataaaataaggagcaccattcctgtgaggattacatcagttaatgtgtgtaacatcctttgcaaagcacctagtatgccctctgttcgtattaaccattactagtattagctgtatgatcttggccaggacacttagtaccattggtcctcattttactcatatgtaaattagaggaagaatacctacctcacagggttattgtgagtcttaaatgaaacctaatatcctcagtaaattgcaaagtactatacaaatttaagcctttgtgagttaaagtaatttaactcacaaacacatgattaattactcttcattaggctgctaatagtggaacacaaatcttatgaagcaacactgtaagccatgcttccacaaaaatcttcttgtttaaaagaaaaagttgagaacaaattagtaagaccaaagaaattgaaaatttcatagaatacccttattctttatttcaattttttataaacataaaacggttgttataaaattaatttacattgagtaccttctggtagttttttctcctagtataatctgtgttgtgcattttttaaatacccagagtaaaattctgctctataaagtcacagaagttccctatgtcattacaacttgcttctgaacaacagtagcactgctagatctgactggcattctgctccccaaatctacttaaatagtaggtttaagcaccacagaattcctgataccagaacttgcagtatccttaaggctgttacaaaagaaatttagcctttctgtgagggaactctcctgatgtggcacacaaaaaatacaacaaccaagtatgaaagtaaagagatattaaattaattagaaatcattagacactttttcggtgttgaggagttaaggagtaggggccaagacctcctcattaacttggccagaaatgacagcatggtttctgttggtcaagaaaacaggtgtcaatcaccaaaactgcattttgcttgaaaacaaataggaagcatttttctggatagctttcatctaaataaaagttagcaacctgcccaccgttctggaatgagttctgtttcttcctcacattttttctaatagaatactgaataaaaagctacaacctttcctaatttctaaacttgccaaccacggcaagtgacacagcatggcacggagcttcttgtaatacctgaccgtgttacattaaccagtctagaaaacaggagtagtaaccttacactattatccctttaagaattccaataaatagaaatcatctaaggcttttcactacaagatttgcttttcattttccatttctttgatacttttctcactcaagtactttcctgatttagtctttcactcatttcttccccaaagtggctgtaatatatttctgagaatcttttattcattcctagaaaacaaaaaatgtccaaaatagtttgctttctttttctgctttgtaatggtctcatttctgtgatgtcaaagttttataccttttccctgactcccttttcaaatatagaagcggaaagtgcataaataaaacaaaaaaaattgaacaagctaaaaataaaaactgacaaaggtagaaaacattctgcaatattctcaactccttcagaaattggaaaatgaaactaaagtttaccaccaatggactaaaagtgccaatttccaataatagctaacacattctagcaacacaatttggtgaacagcctctaaaaggtcatttttatataaataaaagaaagtattgaaaactaaattaatagtaaatgctgaagaatatactatactattttcctctttcaactgctcttttcctgaagagacatgcatgtttttttaatggaatgaatttatagtctatcatttccctgttccttcattatttgtaactttttcacctttcttaaatctttctcacactatcagactcagattagatatgatctccttcaggaggcctcccctgacacccaaattgggctaaaacttgatatttatgttttcacaatacctggcagtactcaccccattatattcacattatctattttctgaatctattctcttactataaggtaggacttaatctcagtcatctttctattcccagaaatagtcctgacaaaacagtgtgtatagaatatatatttgttggatgccagcaggaaagtcttaagaggtagacaagtacaacgtggccaaacaacaattgctagtctttctcttgcctctacaccatcagagacgctctatcctctgagtgaacggctgtctctccactcccactcccatggcccagctaacttcctgtcactttttaagcctcagcttaaaaagcctcatttgtcactttctctaggactgctgaactaataagccggagttaggagcctcgtctacagcctcccttatctatctaattttctctactataggactctgcttcagtgaactctttgcttgtccaaattgcccaattaactatgctgtatgagaacaatgagaaaggacacactgtcgctactgaatccctgaaacattaacgttgactattagggtatgtgatcaagaaataactgatatgtctatggccttgatggttttataggtaaatacgtatccccaaactcattgagttgtatacattaaatctgcacagtttcttacatatcaattatatttcaataaagtggttttaaaaattcataaatatcctttatctgtcaagatcaattaataaacattcagaatgaatacacaaatcaaggaatataatcccgctgtcatactgaaattgcttgggataaaaattacacaaatactccattctcattttcagatttctagataatagaagaagggccgggcgccgtggctcacgcctgtaaccccagcactttgggaggctgaggggttggatcacgaggtcaggagatcgagaccaacctggctaacatggtgaaatcccatttctactaaaaatacaaaaagattagccaggcgtggtggtgggctcctgtagtcacagccgctcgagaggctgaggcaggagaatgacctgaacccagaaggcggagcttgcagtgagcagagatggcgccactgcacgccggcctgggcaacagagttagactccgtctcaaaaaaaaaaaaaaaaaaaaaaaaaaataagagtagacaaatgtgaagactttattttacactgaatttattttgggaataatgttttagaaattcttttcactgaatttattttagtaataatctttcagaaattcttttcactgattttagtaataatctttttgaaattctgtcacctagttgaaattcatcaattattttatcaaataaacaataattgaaagtgtacccaggaaaggttgttttaggatgtgtatcaggtctgaatttattaattatacctaaattacacaaattatactattttaaaacttcttatttctgattttgttttttaatacctgattttctcagccatctgctttaagttttctggagtttggggagtttttgaccactttttgaatttttctccttctagaaaatccctttgccatgctgctctggctcagttctcctgttagatttctaataatccctctctgtgtcctctactggctctcttcttcctattaacggagacctttattttagtcttttgcttcacattttcccctcattgcttcaatgattctgtcttcttccacgaaaccattgctattttgttaacaactcctaaatgcatatctataatctgttttgttttgttttgttttttgagacggagtatacctctgttgctcaggctgaagtgcagtggcacaatcttgactcactgtaatctccacctcccaggttcaagcgattctcccgcctcagtctcctgagtagctgggattacaggcatgcgccaccatgcccggctaattgttgtattttcagtagagacggggttttgccattttggtcagtctggtctcgaactcctgaccttgtgatctgcccgcctcggcctcccaaagtgctgggattacaggcatgagccaccatgcctggccatctttaatcttaataacttctctaagcccacacttctaactaggtatttcactgatatttcatattaatacacacaacgttaaactcatttacttctgaatttttttatcctttaggatgacaccatcattcattgtcatccaagctcagaactcagagccatattttactctcttgatctcatcattaaagcagctaccaataatgtatgctgtactactactctagtgtaactcatgtctacctctgcatcctacttccatcatcatcatcttcctttagaatcttgttatttgcctagagtcaactatgtgaccacctcccaataattttctctaccactatctctatggcgctcccatctatccaaattccaacaatgcatgaactatgaataaatgcctctctgcttgaccttcaaacctggcatagcaagtttcacctaaacttgagggtgtgagatagaagaaatgagaaaggatttattcttattccaaacaggtagcacaatagatgctcaacaaatatttcctaaaatggaattttattatgtattattgaaatgttatcatgccactctcctgtgtaaagagctgtaatgggttgccattgtctagaggatatagttttcacttctgggtatacccttggctcttgtatgcctccttcttccttctcttgccacttgtggccaggcgctctgggatccagccgtatggcaccactgggtgcctttagtaatgggcctatgcacttaccactccctttgcatatagtctctcttttattatttgtatgcctcctatttatcccttaagatttaagttcagaaactttattgacccattctgaattagctgctcttaagataaagcataattctatcattaacgcttactacatctgtctgtttctctgtatctctctcactctatggtaaggtctttgaagtcaggaatccatctttttttattccccggagtctaccacagtacttgtagttcatatattttggtgaaaatacttttttcttctattagttattcaaccaactagctatatgtccttggacaaacttatttaattgactggatttaattttccacttcaggcctgttggcctctatgctgtgctacattcaaaccagaaaacttgaattttctaatgtttatattttttccaatgtcatttttaactttaactttttggaatttttcctacttttaatacatcagtgtcatataccattatctaatttccccccctttttttcaaccttttagtactttgtaagacttcttcataattacaaaaatattttgccaaatattagagttaatcacctattcaccttattccataaactatgacataaaatgctttgtagtagccgggcgcggtggctcatgcctataatcctagcactttgggaggctgaggtaggtggatcacaaggtcaggagattgagaccatccaggctaacacggtgaaacccggtctctactaaaaatacaaaaaattagccagacatggcgacaggtgcctgtaatcccagctactcaggaggctgaggcaatcccagctacttgtgacgctgaggcaagggaatctcttgaacccgggaggtggaggttgcagtgagccgagatcgcgccactgcactccagcctgggtgacagggcgagactccgtctcaaaacaaaaacaaaaacaaaaacaaaaacaaacaaacaaacaaacaaacaaaaagctttgtagtaagaaccatgttctatatgtttttctgtttctcctaaataacactgtccctgcaatacagattaaaaactcactgttaaattaatgaaaatctgtgttacaatgaatactaggacacgttgtaaaagaactcggatagcaaaactgggagtctgagcagaagaatctttcactacattaagcagtatcttcttttacgacctctataattttgagatataatgttcctatttacctataattctttccttcagccctaagccttcaatcaacttactttatattctcatttgcaggtacttcaggcagttgcacagtaatcatgccatccaagttggtcttcccaatgaaggcaggcttggtacgtaatacatctggtgcagtctttgccgtgaccctgtgctgcagcccaccagcactgtttccacgatttgtcagcacaaatgaatatgatttctcaggcttcaggttgacaattaacttctgtgtggctcggccatccacttcttctaccattttcccatcatcataaagaatctaaagagataaaaccaataaaaaaaaaatctggttatcagagaggcaaaatatattttctaaaccaatgtgcactagcttttggaaaatgtatatatagtcaattctaattttaggtgatttctaagtccatgagtagtcataattctggagatcacatcaattttcctgtcatttcctactgtgtaatgataaaatgtttccaagtctatcaaaaatacacaaagatagatatatacatatatatatatagaaaataacttatcaatattagacctgtcagttgtatgtgatcttaatggaatatgtgcagaaaagctctacgtttcaacgtattatgaatattgcctattttctaaaggttttggttcctctttctaaatatacttttactttcaaaaatgtttctctatttcttatttcataaatatgtacttgctaacatctcttaatggcaagccagagtttaaaatgtgccaagaatacaggccaacaaacaaattcagaaactcccagggtattataatataaataggtagaaaccatgtaaatttcattctctggctgaaaaacaaaagcactagcttagatgtaaaaagttcaagttcaaagtagtaggtaacctacaagtgatgccagccctggatttaagctcctgctccttcttcagagtgtaaaggacacacttacaaagcaccaaactgtctcccatgtgaaagtcacaaatgaaaatagcaaggacacgtggccaaaacaaagtggtctgcttgctgtgcaaataacttacccagataaactgtcccctctacttttatctgtgatttcttacaaattagaaaacaacttactttgaaaggcatggcggagttataattctctggaatctcccaagacagcaacacggaagtcttcattactgctttgacatgaaaattttttgcaaacactgctggaaaaggaaaaacagtgtatttaaactattcttaaaacagatgacctgtcctttccaccatggaccataggggcttatgctagatgctgtctactttgatcagagagagaagtatgattttcctacctgtttagagcattcattttaataccccattctcacagagatctttcctttctctccaattcagccaactctattgtgttttccttacctgaggacattggggtgctgtcagccagacttgcttgacattctataactgaaatctaaggcatccaagacgtagtaagttttacatactttacctttttgtttttgctgaacctattaatatgaatgggctgatcagttattatagcttcaaaatactgatttccaaagactgacaatcctttaaaggaggaaggccgtaagcagacaaatcctaccttgatccacaggcagtgtcctgaactggacactgggactatatggcccgggccctttgctcgtatgagcacgtacttttacatcgtatgtggtatctggttttaagccagtgagtgtcatagtggtgtcagctggaacaataagctgctccatcgggagaagggggatgttgatatccctataaagaagggtatacttggtgataatgccatttctctctgccaggacaggtggttgccaagataactggacggaggttgaagtggtgccttctgagtgaaggttttgagggaatccagttggtacttcttctggaatggaaatctccttcaccatctcctccccaaagcccactttgtttctggctgagagcctgaagacgtatgatgctcccttgtggatgtctgtagctgtaaagtgatcttctttttcagagaactcaagagtagtaagtggctccatatccttgcggccaaattttagacggtagccctgaagaggtccaaatgtgtccaccggagggtgccactgaataagagcagtattcatctgagtgtggttaatcacaagccgaggtttccctggaactggagcacatgggatggagtggtaagaccaaccaatctgaacgttcacatttcagtcattgccaaatgagggagttccactctactggtattcccattttcttacttaccaaaacaaaacaaaacaggcaatgtttgacctacatacctttgtggaaatatgctccttgtcttactttattaaagtaggctgagatactagaatttgataatggacacaaaacagaaattatcattgaaacaacagcttaaggggatttttttgacacctgcacgttttaaaccttcacacataaaggttcatatcaaagataaattaatttgagcaaagatcagccaattagatatggctaataagaataactataatgattatttattcgttgaatatgtgcaatgtaccggcgtcacgctaagtgcattgcatatagtattcacaattggtttacattcctgactcctcactacattctcggattagttattattatctctatcttctataatgagaaaatgaggcccagagaggtagaaaactttccaaggctagcatgtaacaagtgagaaatctataaggcaaacccacctctgtctggagtcgactgcttaaatgcttaattgtgctgctatgttgcttaaaagtttaaaaaaaaaccaaactacaaaataatatcgtattgacttactatgaatttaatttgcactttctaactttactatccacatcattcatcaagttcttcatctgtaaaatgggaattatattaagagctattttatattgttcttatgaataataaatgaggaaattcatgtaaaagtcttagcatgaggttctgcattctatcaatattaaccataattattaataatctgaatattaaacttcttatggtgaaaggctagcttccaatgaatacataatttatttacctttaagttagatatgtgaaaaggtctaatctactcattcaatgtattattatgtctgtatttatttttaatggagagcaattattattggaatccacagtgaaagacattgagggatgatcatcagaataaaaactaaaccaagttaacagaaagaagaagaaaggccaagtatggtggctcatgtctataatcccagcactttgggagctgaggtgggaggactgcttgagcccaagagttcaaaaccagcggctgggtgtggtggctcacaccagtaatcccagcactttgggaagcagtggatcacctgaggttgggagtttgagaccagcctgaccaacatggagaaaccctgtctctacaaaaaacacaaaaatagccaggtgtggtggtgcatgcctgtaatcccagctactcgggaggctgaggcaggagcatcacttgaacccgggaggcagaggttgcagtgagccgagatcatgccactgcactccagcctgggcaacaagagcaaattccgtctcaaaaacaaacaaacaaacaaacaaacaaacagcttggcaacatagcaagaccttatctctacggggggaggggggaaggcatggtgtcacatgtctgtagtcttagccactcagggggctgaggtgggagaattgcttgagccaaagagtttgaggctgcagtgagctatgatcacaccattgctgtccagcctgagtgacagtgaaactgtgcctcaaaattatgaatgtgaagaaaaagaaagatggtaggaaaggaggaaagcttacagtaatgggaaacaggtgataaaaaatcataccatggggatatagatgaaggtaaaaaaatcactaaaaagattatgagacaatacatagaatattaacctcagagatggactgattagcctcttcattttgtatttcagaaagtgaaacccaagtggagatgtgctctgctctaagaaatatcattaagatatttatttccttaaccaatggagcaacagttttgtttcacatgctgggaagattcatcacatgctgatataactcagctaatctacaatgtatgaaaacaatagtttctaaagtttttagataaataattattcaacaacatgtgtgctgtgttatacatataaaacatgtgtgttgtgttgtatatataaaacatgtgtgttgtgttgtatatataaaacatgtgtgttgaaggtaggcccaggaaccacatcattgtgtactcattgtgttcctcaggaaaaatgcatccagagatcttaacgaccaacacacactctcagaacaccacccatccataagttggaaactgtgtgaactattccacttgcttttaatatatttacaattatcttaattttaaaatagtactttaatgtagggacattggcagacatctttaattcccctttatgtgtatagagcatttacatgatttgtccaaatgtcagtgatggtgtcaaggattaaacacctgagtctctgctgagaaaaatccatggtgaaatagagctttcaacagagaatacagccttcaatatatgaaactccgttgaaacgagtgggtggaaacacaactattaattctcaatattctccagaggcaacagattaaacatatttattaaaattttttgaaattctagttccaacgaactgcataataatatatacaccgtgtatcctgtttccgtgagatgcacgtaaagctaggataaataaaaataattttttgatctaaaccacaaatagagactgcattctaatatttgtcatttatgagcatgttcttagtaactgatgtttcactttataatattgctatggtacacatttggataaatctaatgggctggcaaagtctaggaaaaaacccactgactttgtagatgtatacatttactcttctgtgggagttaaagcttaggatggagtaatctcttttgtttttgatgttggcatgacctttcttatcctgggacagaaaggcttgttggctaggaatcacgagatcaaagtaatgatatagaaataagagcattagctctgacctactggcttcccctgctgtacaggaggatctcagtctgctctctattgccaaacccacaacagtcattccttccctgggcagaagttttactaagcctgaaaactatgagacaaccagcctggaagtgccacaaagcataaaggaaggactcagtaaagaaatgaatgcttatgcagcttggggaagaacacccaatatcacctcaggagaggctggccacatgaagggtcacacgaagcgatgcctaaaatttccataagcatgtgaataatagaaacagtaaatgcagtttaaacaggctggagtaagggtttgggacagttgtggtattttatccagggaatcaggataggataaaaaagggaaaaggaatgaggagagttctacatcattgaatacatagttaaaaagaattctcccaaactccacagattggcaatggaactcactgcattcctggcttccagaaacactataggtatcaaacatttaccaacaattcactttgtgcaaatacttgtacactggcacacaggtagttgagtgaggaaataaagacggatgcagcagggtccatgttctctaatacaggcatattctagttgggaaaataatcaggtggaatagattgtgcaatctgtggagtcaggtttctaatgccttagggttattctgtagactacttttataagtcatgccagctgttggttcaatggttctgctcactccagcactggagcttgagggttggtaagatgaaagggtcttaaataattactcaggggagttggaaggtcatttttcagcagggtcttaatgaacacattggaagaagcagagaaggtccagttacaaagtaaataactctaaaacttacgtcatgacatataaactcttctcccttttacattttcttattctcttacattcttttaaaaatttcctaggacttcagaattggtacgtatgtgtggttgccctttactttttagcaattggaatcattggagatcaaccgaggtactcagtcccagtggctctaaatttagccccaatttaaactagtaccaacgcaacaacaatcacaattgactagacttgggctaatatttccaaattctccctgtcacagtcatcttttgattatccttaaacatagctgttcaatatagtactgaaattcatgtaaaaatatacagaaaatgtcaaaccaatgaattttctgtttgcctttaacctcaagaactcagacagtaaactaattattacaatacagaataatgggaggattaacaaagaaaatacaaatatttcataagcattgaaacataagagccaacattttcttcagaagcatccttgaggttatatgaatcttacgtagattacttaaattatgatcagtactcgtttccaagatatgattctttacaggttgtagaaacaaggtataataaacaaatatcccacaatcaggaagtttactattaaaataaaatttcacaagaattcctgaattctttgtgggagctgtaactaaatacctttacaattatggttattaggagctcacatctgtgagataaactcagtaattcttcacagtcacataaatatacgaggatttttaatacagtagacaaaacaaattgatatattcactaattgcctagggataaaccatgagtagcggctgcttatgcaaaggaaaactagagcttcgctcttaaaggaattaaatttggattcttctgccttcttcccagatgcagtggggaggtcttacaaaagtaaacgtgtaggcatctaaattacaagcattttctatctcaataccgaagcctctattgattaagaaggatctaaaattgtgaatgaaaattccaaaggaattctatatgtgaataagttccaaaattctaaaatgtctactgcatggtaaataaaaagggatgagctagccttagtgacgttaaaatagacaaaatcattcctttctctaaaattcatattcctcggctataaatccactactttcttgtcatcataacatgaccccatttaatgggcaacaggggagtggtgcttcatataaaacatttcagagttattatgacatatttataagtgtaggtaaataaaatgtattttcttccatttgagattcaattctttgttgttgacgttctaacagagactggatccacagccagatagtcatcatgccatcatgcccctcactgaatacatgcctgctcttcagggcattaaattagcttgatacaatggtatttaaaaaaaaaaaaaaaaaaaagcccagaagactcagccttgaaggagttttgccatctgtaatcctgctgtttgaggcaattccaggtggcaggatgcgagcgaggcaaatcttatgacatttagacaaagctggcagtgagcatggcacgcaggagggcactcaacatcacagctgttctttactttatgcctttacatagaggtatgttcctaaaaagatatttgagaagtgattcgggcagagtaaatcaaatcatggtttacatgttcacgggagattgccatatatgaggattgaggagaatccttctgcaattatctcttaatttactcattctacaatgccagattttccttcatgctggcttttcctactgtggctgaccaaagtcatcctaaaaagcattgaagaaaccttattctttagaggggagtaattttatactatttagccttcttgcttttcttctttttcttttttgttttctatcttttgttcagtttggcttctttagaatccccacagcagggggtggggaagacaaaatgacaaaaggtagaactgtaagtcatgaacccagttcaagatggcagctcttctaaggggatttgttttccagggaagttgacattgttgcttgacttccctgcccagatcccttccctccagatcttcatgggacttgatccttcacgtcatttgagtctcgacttaaataatccttcctctaccagaacttctcagcccctagaggctgcctgatccttaattgcctatacgcttttacttttcaccttaccactttctgacattttattatatactcgttttgtcacttgttaattatctagtcctattcagaaagtgaatttcatgagtgtagattcttgttctgttttgttgattgcttcatccccagtgctggtaacagtgcctgacacacagaaggtgctcaaaaaaaaaaaaaaaaaaaatacttattgaatgactgattgaatagtttggacaaattatgcacttggactatttttttccctgatctatttttttttttttacccctgaactaaaaacacaaaagttgaccatagtccatttatttcctctgattttactataataaaagcctgctagaagctacctataccatttaaaaagttagtattactgttcaaggcacatacatgcacagacatgattacctgccccagtggtggacaccagtttgggcttgctgcgagcaccatctcctttggttgtgtaggctgtgacggtgagggagtaggaagtttcaggctggagcccagaaatgatcatgtcctgaaatgacaaaatagaatgtcactgattcaaaacatgctactaatgctctgggggaaaaacaaggccgtctgccttcattctgcaaatgctcgcacatcccttgcagccatgctaagccctggaaatttcatgcctgagctcatgctatggagatctgttttcatgctgatatcgaaggggcatcttcaggcatcttgggaggtagatcttagggtattagtcaaagacatgaaatctggagccagacttcctgaattcttaaacttaaacttgcatgtccttactagcttggacagaccaagtatgtttacctatctgtgcctccatttcccatctgaatgttggaattataataggaccccataggattatatgagttatatcaggtaaactcacagaactatgcctggcttataggaagcattccattaaagagtgattattttatgccaacagctctccacacatatccactgtaacccacagactacagatggggctgatgccagcatagtctgttttatcactatagacgaattttgccaaatggttgttgttggacctagataccctgagagagaattttcttaggactctcttattaatggattgtattatcatttttattggttatttgtataggctatgagcagaaatcattatccactgaggagaattttcacacacattaaaaagcagccataaaagcaaagaatacaacaggactttagttttaccacatcactagtatgtgctcaatttattttgactttctaaaaattgttaaatatcacatactatttacctaaattcttagttttctcttagtcagggcccaaagctgtggtggttataagaccagatgctctttgatatattcctttaaactgcaggttatgggattctttagagattctggctattagcttattctagtattttaagaacaaataccagagctgcatgtacacatgcgcgcgtacacagacacatgcgcacacacacagacacacacagacacacagacacacacacacacacacacacacacacacacagcaatataaaaaccctttcagatttttggcacagctgtgttttcaaattgaatatggataaatttaggaaaatgcacaatgtcattgtcttccaaatctaaagacaatgtgagtgacgagtacgaattatattgtgtgaaatacagtaggtttttttttagcaaggctgtaacagataccgtagagctcaattgttgaagctgatcccaaatatgacagtttctgggaacatgctttctcaaaagagtaggaatatctcactgtggaaattcaagaagttcagatatcatcctgaagagtcactggaaattttattctgccagataaatggactatttgggagaaatgttgtatttccaggaccttggaatggtttccctaacattccagaggatagaaaaaccaagtaaactacccaagagcagtattttaaatgacagcagacacactggctatcccaaaaactatcatgagtaaatgccaacattatggtttccaaggttcccctcacatgccactggagtactgctgaaaagcagtcatggctaactggaaaaagcagcaaggcttgcttccatcaccaaattttgtagcaagaaattatgcactctgagacttatatgtttcttatcatgaaattggagttaaccacacatatccattatcttgcccaggttgttagaggataacagacataacgcaatttgaaatgcgtcaagttccctgcagtggtataatctcggctggacacacctccaactgccacggtcatatcctttcttggattacattttctttctttaagtggtgggtgcacttccttccttggttgtttcagtatgctctgtgaggtgatgtgcctgatattatggccataattcctcattctctttgtttcctcctgtcctgtctccactttgcttcttgtccctgactgttaaaagttggcatacctgaggttctgtcacagtcactggtctactgtttctctaatcttaaaaaagaaactgcattcatttctaaaccttaaataattatttctgcccatattcctgatttatttccagctgtgacttccaatctgagctccagtggcatatacattgtaaatatctgctagatgttttcctgtgactacccagtgttacttcaagttcaaatgaactaaaacttaaaaatcattcctggaagtagactccccctccttacttccatattttaatgaacggtaacacatctgcaaaacttatgagctatctttgacctctttctcttcctcagttcttagcaagtttttgccaattcttccttttattgatcctaactatcactttttcatttctactgcctcaactctgttgcatttttatcacttcatgactaaattagcaaaataactctttttacctgctttcctatctgccacctttttactctctaatctatccactaagtcactggattttaaactgcaggtaatgacccatttagtaggttgtgaaatcaatttagtcagtcatgaccagaatttaaacaaagaaacaaacaaacagaaaatgaagtggaataaacttgaatacttaatgttagtgtttattatacatttaaagcatggttctataaaaattttattttagttaaacagaggtgtgcattgaatcatgacatacaataatgtatttcttactgtgagttatagtcaaagaagtttacggtcaaaaatgctgctgcactggcaatcccatgagaactgataccttgcacacagttacaagattcccaacaagagccatgtgcattggcagtaaatattcattcagtgaatggaagaataccgtcttgccagcctttaactcatttttctttttatttcttctatatcactctaatattgaagagttaaagactgaccggccagctttttagcttgactcttctggttttcccagtattatattatagtttacctcttagctctatttaccactgagttacttaacacgaagccttcatttatatcaaattgtcaggctcactgtcacgtgactataccacatgctcaactgtctcaatgactggttttgctgtgatcaactttaaaaaatatgtatgttccacctccaactctccaacacacacacacacacacacacacacacacacacacacaaacacacacacacacacacactttttcacttattcagtctttagtcatcccttaaattctcaactaagcttcaggacttcttttactatcttggaccactgtctctgaattcatagcttttattgacactgtccactaatttactaatgcatggtccactgctgtaggccatatattttgctgcgttctatgaaacttttcagaactttactcttccctagccacttagaatgtaaacactagaaaggcaggtgtcacatcatgtgtcccttgcagtggcatatacataacagtccctcaataaataacatagagttttcattcaaatattttaaaaacattcctccctcagcgacatactttctacttcttggcataatccattcaccattcaaatatgtatgggtaaagtgaagaacagccacttctagttagagttaatcagtgccagatctatatcttgttatctactggatatgcgatcctggagtcagatttatgagcattatgagcagcctacaccaaacaatctgacatctccagtctgcaatgccttcatttaaagcaggcttatccaacatgcagcccaacacaaacttgtaaactttcttaaaacattatgagatttttttctgttttagctcatcagctgtagttaatgttagtgtattttatgtgtggtccaagaccattcttcttccaatgtggcccagagaagccaaaagattagacaacacccctgtgttttaaagcatgcctcctctgactgtcacaaggcagagttagtagcagccatcaaaacaaatatcacaagcccatgacatttcttacgcagtcaatagcaccatgctgatttcacaaaacaaaaaccaaaataaaaagtgcaccacacagtgaagataacttaaaaataatttgttagttcatgcatccaagcaaactgtgatgacagatcacaaataagtgaaaggatgtcagagaaaacaagcatatatagtctgcttttgacaaaacagtcaaaaattactcacatgttcagtagtatcatcaaattcccactgattgagaataagaaggttgggaggaaaacaaaataaaaagaaaaagaatttaaagccttatacaggcagtgttgcccttgttagattaaaaaaatcaaaaaaataaagcagtgtgtacaataaaattccaaagaatgtgtgatttgctgccacctccacctctgattgggaagtcaaattaaatatcctttgttactgttatcactaaaaccagctaacattctttaaatgtatggttcactgaaacatagcaatgaggcacagaaaaagttaatgtttctaatcatatcctactcgtatttattttgacttctatcttaagttacacaattaaaagtcactatttagattaatatctttcattatatttgacacttataacttcaatgaagtcctgtgagatgtaatgaaatttcagtgaagagtcaaggaaagtaaatgagatgggaaagaaagaaaatacacaaggaaaaacagcaattaataaagaaaagccaaagaagaagagaaaaaaagacagagttcacatttaatgcatttggtattatataatttcgttaactaccatattttgcaatggaactagggagagaattacagttctgtaatgtaaaatatctaagaaccaaaggagaacaccaaagcacactggtcatattgttttcttttccataattgtagacttacaagataaaacgtagcaatgatggctttaattttatactacgataactttctttttataggcactacataataattatttatacaaatcaagtcaatggcccctttccagtgttgaaggggtattacgaagcactactgcatttacagaagtggcctcggggtagataagtgagcaatgaatccagatccctttacttagaatgtttcaaaactgaagaaaacataaagacttctgagagttgacttgtattaagactttgggggtaagtactttccttagaggcacagggatatttattgctgtcttatttttttatttttttaattttattttttgagatgcaatcttcctctgttgccaggctggagtgcagtggtgcgatcttggctcactgcaaactccacctcctgggttcaagtaattctcctgcctcagcctccctagtagctgggaccacacaggcgtgtgccgccacgcctggctaatttttgtatttttagtagagatggggtttcaccatgttgagcaggatggtctcgatctcttgaccaggggatccgtccgcctttacagacgagaacgtagaactgggcaacctggtgccgcagttttcaacttgcttcataacctttccaactttcacacaaagaaacgcattttcatttgaaataaatttcaaatgtttttacaaactccatccttttccctgccaagtcaccaatttcttggataatgaaagtattccaatgatcataatatcctatccccatgacatctcatcaccatttgacacagcaaaggtaagccagtacatgagtcatgtacaattttcagcatggtggttacaagatgaaatcttcatcttcctttcaggaaaatatgtaaaactcaagcgaatttattatgggactatctttgaatcacctctaatttatgaaaaattttggaaattttcaatgctctgttttaaacaactaattataaaaccgggttgtgataccatagttgcaaaccactgccctaagatcaatacaatttctcacatactcaactactcatttttagtaccttttttttaaaccttggttcaacgtaaggatcccacttatttgctaggaaattctgatttaatttttaatatcattgtaacgatcttcatttgctgggacatgaaacaatgagtttcatcaaatatgtaatttgatgaagaagtactaaatataatactgagtacctgtccctgaataaaaatgtctattcttcagtggaagaagacacacatttagaaattagaacaactaagttgcaagttgttttagcacagaagaaagtagactccatcagcaaaattgcagtttagaaatcttccctttgactcaactaagtcaatcattttttgaagtcagaaaggcaaactcaaatatggttgtaaagggttgaatatctgtattttaaggaaaaagtaacatgtttttaatcagacttgagtgtcatttcattacaattcccttcctcacttgatagtaactctgattgaaaagatcaatatacatcaatgtgaaatgaaaactagaattttgtataggattttttaaatgtcgaaaaactaaaataagagcaatttcaggatatgaactaagataaacttattatataaaaacagaggtacataatttcagaggcttacctgtgcatcagccagcatgacatctttcagcatgggctggcccttgggctcaccattttccatcctcacataatgcacctgatatcctcttatctggccatgctgtttattgggcacgggtgagcgccatgagactttaacagatgttgagttgacagcctctacctcgactttgcgaggaggaccactaggaactggaacaacatcattggataaaagaaattataggcacttgtcccaccctatcagagcattttctgcattttctttacttaggtttctctttcaaaaaatgggtaaacccactatgttttctttgaagaatacaaacattttcaaccaatgaaaatgcttaaccaatctgctctaccttttaagaaaagatcaaaaaacatgaccgatgcaaaaaaaaaaaaaaaaaatggaagaaaaaaagagtatcagagaaatagaaaaacatgtaaaaaatgtacaaaagccaaggaagatgctttgaggttcaaagcattaaagcacaaagaggtatagcattgaaataataacaaaaactggctgttgattgttgtgtgttttttaaaggtttctttttaaacggcagaataaaaagattcttgattatatgtattatcttctctttttttctcatatcaaagttattccatacaaaagatgccaaaaattcaatgttgagcatcaatgtctctgaaatatgtaagacaaaaaggcaacaaaaaggtaagaaggtagttttgaaaagttaacttcaaaatgtaaaagaagtgactacaaaaagccaagaaaaacacagaagactttagatggaggcacagagacgggctggactgcaagaccataggagccaacagttcttttaaagagaagcaaattactgcattgagattgaaaaaaatgaaaaaaaaaaaaaaaaaaaaaaaaaaaaaaaaggccaggctgtagcaaagacaagtctttggcaaaaatactaaagtaacagcaatgctgggtaaaaagatgagcagagaaaaaagattactgtgagcctattgaaagacagcagatcaagactgtgtcagaagggtgcaaactgacgtagcggaggcaacataccatcttcattggttcgaatcaacacggacaagctctcagggccagggccgacatctgtatgggctgtcacagtgatccggtattcagtccatttttccagctgttccaaaaggtatttggtagtgtccgaaggaattcccaaaatctcgtgaggcttgtcatcttccccatccactgcagtgtacttgatggagtattcagtgataatgccattctgtttttccactggtggaggttgccaacttaccaaaatactagtggaacttgggctggtgcaactaatgtcttgaggaggagctgacggctcttattttggtagtgagttaaaggaggatttaagtgaaaggacaggagtggttgaaaaaaaaaatgataaaacaaaagaaaaggcaaaaataaataaacgaacaataaggacaaaatgaaaataaggctttgaaacttaaattctaatgacaaattatgtaccttggcttagtaatatgaataaaccaaaaagagaattaatgaccaaaaataattgttaaataatgggtagggggaatatgtgaaaatgagacctcgagataatggagcctcaaataaaattacctacctgcgataaaaattcttctaaaccaatccctcagtatctcccacccccactatactgactacccagcttcaaaaaagctgcaaatagtgctagtatttacttgagggtctgatgatgcctcacagatgtttccaagctttcacttctatattctagaatgaggatggtttacatacagtactcatttgtgaaaggcttcttaagtgtgaaaagttgcaataactgctaatgcccttctaccagttccaattaaaaataaataaacaacaaacataagagggttcactctatctgaaaaactgagtttgcctgaccagttttaataataaaaaaaatgttaacattgatcatagcccatatacagtgagcatgcagaatcaataaaggatgaaaatgcagagtccaagatttacctacccgagggtaatgtcaggattgttgattctgactgtaacttgtacttaccctacgtcagctttcagctttttaattataactcttcttgagacaccattgctagtgaagaattagaccccaccagcaaaatttggtaaaatcaataataatcatttatcccttacaaaatgtcaataacacagccattaaaaagaactgtttttttaaaaacccaagtatcaactggaaaagatataatttctgtgcaaaatttctttcattttgtacataattattcatacaatgtagggtttatattagaattagaagacatactttcttactgcccattctaaattaaactagtcactttctgagcaatcattttccatcaaattaaccaagcattatgattttaaaaaattaaaaatcaataaaagacagcacaattactatcattatttaaaacttaataatattatgttcctaaagaaaaacaaacaagtgggcaaagataacacaagtccatacacacacgcatatatttttaaagcaatgtatatggtagactgaataaagcaatcctatatttcatatttgaatgtgtagtctggggatttccctagactttgtgactcttaacattacggagtgccaggtgtatccaattgttcaggggattatcagtctttcttaatgtacgtgccttgtgttcattattacagtccatcaaaataaaagctctctgtactgacaaaaaagaaatcctcataggacagccttgtaaatttggaataagatttgcaaaaccactagaatctcatttttattgattctgactaggggttcttatatctcaaattataaaactattttacatgcattatcattattcataataaattgagttgttcatgtaacagcaaggactcatctgtaattctttttaaaaagctgatttggttttcactagggctatcttcagacctcctattttgtgagaatatattcaacaccatttgaaaattttactttaataaaataaggaatagataagtgtttgatgtgcttataaaaagtctattcaatatgtatgtgtgtgtgtatatatatatatatacacacacacacatatgttaaaaactgaggtttgtaaaccatgggaaatataatattgaagcatgtaacatttctcttaattaaaggcttggtttttagaaattatcttctacaatactatttattagcctgcctggaattcaaagcagacatacagagaacgcattaatttacatgcttacgcctttaaatgaaagaaaattttatgggaataaacgataatcactaatagattaaacatgatcctaatcattttcatgtgaataatcatgctttaaagagggaaaaacataaattttattatcaaaaaaccctgaaagttttcaagtttctatagaaaatgaaatggtggaaaacttgcttatttgtatggaaggaaatgaatcttttaaatcacaaatttcatgtttgctgataggtctaaatatgaggttaacagagcatcttcttgacaaaattcaatgtatttctactacagatatctattgtataattcactatgtcaaaaagtaaagacaaaatatcacacaaagaaatctaagaaaataactcaacaaaactcttcaattcaaggtaaatagtattttttatgaatgaactgtaaacacatactaataaaaagcaattaataataataagccaccaaactttccaccaaaaacaaaatcctgtataatactttatgcaaaacaatctgccctgggaacaattaacccccattgtgataaacacagctatgcttaagggtaacagctccaaaaagaaattgaaccccaggaaacaaaatacaatttagaattgcaaatatgtttgcgattattccattgtttcttaatttgtccacatacagattttctgtcaatgttccaaatttccacaggtactacacacagagttaataagaaacaagtcatcagagctgagcttttcttagtagaaacaaatacatgaaataaggacttgtttgattgcaaagctaaagcctgtgtgcttaaaaaaataaagtttttttttgtcttttgcagcctctttcatttgcgaagccctcctatgattattttacagggttctcaatgtgaattttgctttaaagacttgtaattcattaaacagggcttgatctaactcctttaacccacatttcacccatggacgtctactaccttctttaaaagtctttcagtgtaggaagtgggaaggtgggatctgttatttggatcaagtgatgagaccaaaagaagtcacagttacactttcacctgtgaagtgtgatgcatactaacctagagactaactattaagcatattagcaggtttgcttattggtgaaggtgaaagctagcaacatctccccgaggaaataaaaaggcagaaagtaagcaaagagagacacctacttgactgcatggttctagctgatatttctgcagtagaagcacccaggccttgaggggagcgtgcagccagacggaaatagtataagctgtttggtttcagtccttgcagcctatatgatgtccctggctcaatggtaattcgttgctggaagcaataagagaatgtggtcatcttcattaaggttcatgcaaatactttttaatcatactgtctggaccatcagatttctatcatcaggattataatctcatcaaaatatcaccaaaagagtcaatagtgagtatccagggctatactaaggaaattatataatgaaaatatcagtttaaaaggcaagtttctacaaaggtaactggaataagggaagtcagagatctttttaatgttgacacagtcagccaaatacatcagataagacgaagattgagaggccaacacccatgagtatgttctgccgttaaatgtgtgtatgttgctgtgacacagatcacaatagaaaatgacacctgcccctggtagtggaatctgcccaacatgtgcaattttaattgaacagatgtctactcatctcccatgaccttctgaaatctcaattggaggcaaagaaaacatgaccagaagtagcaacagtaaccagtatacaatttacaggaggttgctataaaagagatttgaaattgccaagttttaatgggtaaaatatcacgttagtcactaaagaaagttgaataatttatctgaaaccacattactaccctaggttgatctaaaataactgaaaaccttactttctttgtgaataaagaacccacagccagaaaaaaaatagattcacaaatgtttgtggacttttgatatacgatttcgttaatcaaatgctataactctcaccttccgtgcttaaaatttgtcatttagcaaaaatataagtgtctatgggtaatcaatcttgaacatcagcctgcagtaaaccttaaaatgcaagtgaatacataatctagtaatggtgtgtgtaatcttaacactttatcaaatagtgtttgctattcacacaaacaaatcagttaagaagaattcaaggccgggcacggtggctcacgcctgtaatcccaccactttgggaggccaaggcgggcggaacatgaggtcaggagatcgagaccatcctggctaacatggtgaaatcccatctctcctaaaaatacaaaaaattagccgggtgtggtggtgggcgcctgtggtcccagctacttgggaggctgaggcaggaggatggcgtgaacccaggaggcagagcttgcagtgagcagagatcgcgccactgcactccagtctaggcgacagagtgaggagactctgtctcaaaaaaaaaaaaaaaaaaaaagaagaagaagaagaagaaaaattcaaatataaaactagagaaaccatccctagggtgttctgacttacaaatacaaaagttttcaggaattttagatccaccaagtaagaaataaagaaattccctaaataagcaattgtggagcacagtagctatgccaacatttaagcatcacaattctcctttactctttgtatatatgtatgtttgtgtctatgtatgcctgtattttagtttggtggtcgtgatgaaggtttaaacaattcagtgctgatttacaccttacagaaaacaccaatagctcaagttgtaccatgaaaactttaagtcatatctgcatttcaactatataactttttgagtgcttgatttatattggctttgttagctaaatctaaaaccactgcatttaaaacctattcttttgagattctgctcaattcaaacagatggaataaaacagaagtttacaagaacatattaatttattataacatccaaaattatgtactacaagttaattgagagtagttcatttagcatgtgagttttttaaaagatattctttattagaacacagggactgtttcactttgtgaagatttttttttcagataaaaaatgctaagaggcataataaaatgaatatatgtgtgaagttctcaaacacagtgccattaactccttttgtcctaatgttccccattggatttaacaataataaaagaaacatacttactactattatgtattctcattctgaaaatgttagatgtatcttaatatcgatttctatcatgtattcaaactgcactcaagaagcagtagaccctaaccgttaacaacacagactctggaactcgactgcctagactcaaatcccagctctgccatccactagtgcgagactttgagcaaattatttaactttttttccatgcctccattttattatacgtcaaatcgattaataagaaaggctagctccagtgctactataaaaattacatgcattattgatggtgaaacccttagaacagtgcccattaatgagttaattatattgattttcatttctcttttcagtgacgatcaacaattgccatgccttctacaatctgttatttcatttgcacagcatactcaaatgttatacacactcaccttcataccaaatactttttagcaaacaaacatttgctattggggaatctttgaaaccagggtggaaaaattcatctagccaaggactttcattaacatatagagctaatttagtcacctgtccccacagtgacttaaatactttcatgaagaagagaaagtcctcaagtctcattgagtatttattcttccataacctgatacatctatggaacttggaactctgtcagaagcacattccaacaggaacaagagttattttgttttgtttttccccaaagcctccaaataaccactgttttttgtcattgttgttgttttggggtttttcttgggggggagggggagtcaagttcctcttttaattagtaaatcttttccatcaaggtcctcaatagctctctgaccaagaatgtggataaatacacaaaaataaaaaagtggccccacgtaatgaataattcccaaggtgagaagcactatagtcttacctcctctccatgctccccatctttgtagaccagttcatagttggcaatggtatctgaacgtggaggtgtccaagagagcaaaatacttgtttcagactcaggttctgctttgaagtttagtggctgccctggtactaaaaacagggaggcaatggattgaactcacaatcaccaggagtattcacaaagttcttccattagcgtaacctgcttaaacctttcgaaatctgtacacatgtaccagcttagtggaaaacaagctcctttaccttgtccaagttaacctctttgtgtacagggcaagtacaatgttataaatcctgctctggagtagtagaacatctacacaagatatagtagaactaataagtataaagtatatcggcctctgaattcaattttaaggaaaaaattctttacttcatgatatggttgttagtaataaataatataatttacataaagcacttgaaatattgccaaaagcataataagtacaaaatacctaaaagtattgttatttacaactgagtaggaacttactctctagcactacatgtaacattcaaaattatttccaattaaatttatgaaatcctacctttacgccaataacaaaacctaacaggcaaacagaatcactcagcattttttcttaccagcccacattttgaagaagaggtgtaagaaaggaaaaacaaaacaaaacaaaactctatcacttacaaataatgacttctaatctctaaactatgttaaattatttaaagaactacacctaatacaaacaaaatatcctctctagtgccacaaagctaaactactacaaaaattaagaagtttataggatacacttatcagaaatatggtaacttaaagagatcatctataattctcatgttagccatgtcatctattcaacagacaatttggaagagctgtttatcagctgtaacaaagaatggaaagtctattcagtttaaaacaccttactcaaatgaactagaataattagtaacctaaactttctagtccacacctaagcctatcagttcccctctatccattatacacaaggctgagtcagggtgtcgctggcacatctaatcgtacattgttcttggccactgtctgctctgattggtgagtgcctatgctttcccaattgtaaaacattttgatcattacccttgatattatggcatgtctcaatgtgctgtggctgaacatatgttcatattccctcaagtttaaataagaattccatttatatttaaagaaaaaaagagaacaataatacttcatagcagaggagtaaaaaaacatctaaagtgtgctttaaaacatctaaagtggcaacctcagcaaaaatatttaaaaatacatataatacagtataatttgtagttcaaaagaagcctttggagaaaatgtattgctttccttttcttttatagttatgtctgtgtactatggctttaaaaaatgccctttgttaaagcagtctgcaagaatgatttgtagaattcctaatgataattttattcctctggtaagtcagcctgtgtatatatatgtgtgtgtgtgtgtctgtgtgtgtgtgtgtgtgtgtgtgtgtgtgtgtgtaaaggaatatatgtttggactgatgcttaaggtcacaaataatcagtgcttcatatttctagttgccttcatcatcttttctctctctctttttaaaaatcacaggccttgagagtctcattgatttgatgcctctgggagcttaccttctgaacagagtatcacatttttttccccagtacctgcccagtgggtgacctaacacaatcatttagattgaaaggtggaagcgaaagaagataaaagattgagaagcaagaggcagagggacagaggggaacaaaacacaaataggcaaactgcaaagcaaatggaaaatgcattatttctaaaagggaaataccaaaagcactggcaggagcaataatggaaacaagagtgaccagatagatgggaaaattatgataggacctaacctaatattcacatgataaaagggtttctcaggctaaaaatgcacacatatgcctatgtatgcagtcactgatttttttcctagttttatttgcttctttctttctcccaatttcctgggaaacaagaaagtttgtgttaactcctgactcaaaccaaaccggactacagtatggtcaagaattagaaacacagacaacactgaagggctgctctcgggataataattgcttgttacgcatttcttccctgcctaatgctaataataaattgacattgattgaaaacatcttggaaacctaattaactttttcttacttaaactgtttactttttgcttttaatttgtcttgagtaaattcccggttggtctcaatatttcattcttgtttagtgacacaagctttgtctgatcatctaattctgcttgtttctattaagagccccttccttctaaataatgacttaagtaggcacatccaagtctcagagagtacactgtcctttttattcttgcacaaagctaaaggttggctagacgacttgatgcaaagtgtcttcatctaatgtacagggggttctctcctgttctttccttatccttcttttgaaatggttcggaggttaacttcatttattagattttaaacttgtggttcaggcttaggcatggtaactcacatctgtaaccccagcactttgggaggccaagttgggaggatggcttgaagtcaggggttcgagaccagcccaggcaacatagcaaaaccctgtctctacaaaataataaaacttaaaaaaatcagctgggcatggtggagcatgcctgtagtcccagctgcttgggaggctgaggtgagaggatcacttgagtccaggagcgtgaggctacagtgaacgatgactgagccactgcacaccaccctggatgacagagtgagaccctgtctctaaaaataaataaataaataataatatataaaataaacatgtggtgcgaatacaaatgctcagaggtgtcaggtaatttagatgagtgagaaggccatatggggcctggggcccggtggagagtgcccaccacctgaagagggaccgcaggccatgctcagtgacagcaggttgctgccttgtgaaatgtgggcgcactcttgtcccagcttccgatttccttcacagaagttgatcatgaaccttccaggtaaaacctttccattcttaattactaaaaattaattgaattttaaaagcactgtatggggcaaaatgtgtctacaggctagattcagcatatgggccatgaaataaactttcatgatctcaggctccaggctcatcaatggcttaagagtgcactacccacacttcctcgggaactgagggtgtacctaacgatatcacttcctcagggcattttgtcatatttgaatccacaaccatgaagctgaggacacaaaggaatttttttaaataaggtataaaatgaatgtatttttaaattcccaacatattggtcctaatgagcataatatatgtatataagaaaacactttgttttctctggaacacttgagacatgggactactttcattatctgtctattgaatttttataccaaatattgggtctacagaggttccatttcacatttctattaatgttttctctctatatatgtatttatacatataaatgtataaacgtaaatatttacctacattttatttatatatttatttagttttgagacaaggtcttactctatcacccaggctggagtgcaatggcacaatcatggttcactacagctttgacctccaggtctcaagtgctccttccacctcagccccctgagtagctgagagtacaggtgtgtgccataacacccggctaattttttaatgttttttgtacagacagggtctcaatatgttgcaccaggttgtctgaacttcctgggctcaagaaatccttccacctcgaccactcaaagcactgagagtatgggtgtgagccactgtgcctcgccttcttacacacagatattttatgctcttgtaatcactacacatcacggtttctcactggtatttttttttttaaccttcacttaccagtcctttgtctatgtatatcttattttatttttattttattcaagagtttttctgtgttgtaacatttccttcactgattaactgaacataaattttataagaaaatgtgagattctgggaaaatcatgggcaaataaaaacaacatatccagacctttaagcagttacttcatattcaaaggagagatatgatattgaccataaaccagatttacaataggacatggaaagcaaaaataaaagaagcaaaaatttttctttaatattatatttaagaagtcattatatactgtaaaagtatgtccgccctcttgattacttacttaatgtccacaaggaaatagaaatgtgagctatcgagtccctaaaatgagatcataatcctactgatacatgttaagtacttgagtattactataattacactctatataaatatgtgaaagcaactccaagacaagggatgaaaaagactaacaagagaaaccttcacattatcagatgctgatatattagaagagattaatatttgaataaaatgtagagattatctctaaagaaaggttgacacatattgcactgctaaacaacagtttcatcttgctatagtataaatatgaaatatgaccaaagatactagaaaacccatgattgctaaaatatccagtattttattaaggtacatgttttaaaatgtgtgtatctagcatattgataaatgataatgacaataaaaccgacagccagaattataacggtagtaaaacaaagcaaaattcaaaacaaagagtctgatgtgtaaatgccacaaatatatcattgacaaaataagtacttaatacacaagcatcagcacaaatcttattctcaacagtcattaaatataaatgagaaaaagttaaattttattatagttgtatttatatccagtgctcctttactcattgctaaatctattcagaaaaagcatttaaattggactcataactttggttattagaaagcagtctttttctagtttgcttgtataggcctgttgacatacactaatgaaatgatttataaacttctggaaacctaacagactttgtctctcaatgtcatagcttatattttaacacttttgcaatgcccagaatttgtaatagcattaacatccctaaaatgtttaaagttgatactagtcattagtatttgataaatatatataattctttatcttttgaaggcatatactgttaaaggtatatccatataagtcagatgattttcaagaatctattaaatgaatagatgtaattagaggtcagacatgctttctaaatacagttcagaaaaaagacacatattaggatttaagatttataatgcctctaattagcatgaacatcaagcaacatttaatgcattaggtttgagatttaacttactacttctttgtcagagttttatttctacttcttctataaaatatagttaccctatgcttttggtacaattacctttacaagaaaactataggaggtccttttttccttcctgaatgtgttttctaataatgaaaatatttttctagcttaatataaatactttccttgtcaatggccatatattccccatattttcaaggtaaactagttgcaagtgactttgtaatgccagaagttagagctatggagaactgagaagattgacccatatttcagaaaataatcatctcaatgaaagtcttttcatatttaaaaccatttaaagattactcaacacggtcaactgtactaatgttcacaatcaaggagaaaaactctctgactgtaaaacagacagatcatattctcattttctgtattaccagaaatacacaaatttacatcaatccttcacttatgtccatctgtgtgactcatattagatcaaatcaaaagtgagacttctctcttaaactcactttgatcctaaatactgttcttttggaatccggtttcaaacaaaaacaggaatgtgaatgtcacagaatgaaagataataaaattaaatgagtaccttttagacacagaagacatcaaaatgtacatttctgtgtatttgtatttaaaatgtacttcaattcctacatattattgatcagtaaatttttatagggttagaggagaaaaattgcagtgaaaataatcatatccttaaattttatatctcataatggttatcgtcctagcaatcatcctaagaattctttagtcagtaactttcttgttactcctttttcttaaggagcagctcggcattaattacatcagaacaaacatcattgtttttggtaggtgtccactaatatccactggcctttttaattaagcctatagaacagatcaaatcattgtgctattttggaaggttttcttagcttattgagcttggcaggcagtcattacatcactatatatcttctcaatcaacatgtattaaaagtaaaactattatggaagattcttggaaacatcttcatgcaaaaaagtcagttaaacagagtgggaataactattctaatatatccatgtcccattcatctagattttctgagttctgtcattaaattaaatcagagcttttgaaagtagagtccccagctcacagtaactcagttgcccctctgataatgctaccttcactgagttatgattcaatgtcatattctgtccactggtcatataaaaaaataaagatatggtctgtctacttcaacattacttctatatttttcaatagattacgactgaaggcatcagggtttttcatttagcattctaaatacaaggattctcacaattgtctaagattcacattttggttggattaggtttaggaaaaattttgtttctcagataatcttcctaccatcagaaaataaaaatatgaaacactatagatttctatgtttaaactggtgcttataaaacttagagccaaatttatttaaatttagttaaatttcagccagatttactgcttgagtgtaacgatctttcataaaaatgttcttccttccacttcttttagataaacttagtttttttttttttttccatttctaaatgttttcatgtacttctgcactggaataatctaatagctacctcagtgtttcagaagtaagttatgtataattcttagataaatatatgaataaatgaaacaattgcgtttttctctcttgcctcttttcattattgaatacctacactggcataaaaacacaaaaactatcacattaagcaaattattaatttaaaaggtaatggtagttgataatgattaggctctgcgtccccacccaaatctcttctcaaactgtaatccccatgtgtcaaagaagggacctggtgggaggtgattgaacaatgggggtggtttctcctatgccgttgtcgtgatagtgagtgaattctcacgagatctaatggttttataaggggctcttccccctttgctcttctctctcctgccaccatgtggagaaggtccttgcttccccttcaccttctgccatgactctaagtttcctgaactctccctagccatgtgaaattgtgagtcgattaaacctctttcctttgtaaattactcagtcatgggtatctctttatagcagtgtgaaaatggactaacacagcagttaaaagtatccagaatccctggatttaaattctgcttttgcacttagtaaccttacgacctacggcaagtttctgaatcacgttttatcctctttgatcttcaatttactcattggcaagtgggataattccacatctgcctaattggtttgtgagaataaatacatgcaaagttcatagtatagtgtcctccatatgttagctactattatgatgattacatattaataatttaatgttttacatattaagttacaaaatgtttccctccattatctaatctataccctgttatgaattttattgcatcccacaaaaatccatatgttgacatcctcatccccagtacctcagagcataaccttatttcaatataggatctttgcaatggaattagttaagatgaggccataagagtgaccccaagtccgttatgactgtgtactagtgaaaagggaaatttgggcataggcatgcttttgggaagaacataatgtaaagatgaaggtagtgatcagatgatgcttctacatgtcatggtacagcaaagattgccagcaaaccaaccaacagaagttagggcagcagcattaagtatatttccctcacagccttcaaaaggaaccaatcctgccaacaccttgatctcagactccctaggccccagaactgtgagacaatagattcccgttgtttaagccacctagtatgtggttcttttttacaggagcactagaaaacaaatagaaccactacactctataaggtggttattattatagactagaaaactgaagttcagagagagatgacataaatcacctaaggtgacagctaataaacgaaagcttgggcttcaaaccctggttatgttactccaagaccagggattgaaaaaataatcacagctgagaaatttaaaaagctcaaagtggaatgtaagttcccatataatttcttagaattttttaattgttatgtagctgctaaaacagtataataaaaagcaatctcataatagttaaccacttttagtcaagaaaaagcaaaacaagatttacggatgtctacatttcccaatgagaagcttttttggtaagaacagcctacagtattttttttctgcatattactacagcaaataaatacagaagtactgcaaatggcacacagagaagatatatggatagtttttaatacaactgtggtgagacatatttttatagctggctttcctacaatgtcatagagaaaagagtaaatccatgaacaagccaataagaaccaaataatggtatgaaaataaaggcaggcgaactattaatataaatgtgctctgagattcctagaagcaaggacaaatagttaaacatacttcatataaagaccatgccatgaaaacaagtcagtgattcacaggtatcagtgaaatagatgataggtacattatctagtactggcatctgagaaaatttattaattcattgccaggattagcaatgagttatgtctacagattatactgtctccaataatatgattattatgtagatttcaaaacaagccaacagcatgatgccaaaacattcgtagattaatgcaggtttaaaagatgccaacacaataaggagtcaaagaagtagctctcagatgctcaagaataaactttttttttttttttttttttttttgagatggagtcttgctgtcacccaggctggagtgtagtggtacaatcttagctcactgcaaacttgcaaactccatctcccaggttcaagtgattctcctgcctcagcctcctgagtagcaggaattacaggtgcctgctaccatgcccagctaatttttgtatttttaatagagatgaggttttgccattggccaggctggtctcaaagtcctgaccctcaagtgatccacctacctcccaaaagtgttgggattacaggcgtgagccactgtgcgtggctcaagaataaactttagaagaggcctgttattttatattagcccaaagccaaactgatcaccttgactcaaagaccaaagaggtttgataacctcttagaaaaataaaaccactgggagggccaagttttccttcataaaatagtctaatgtctgctgtagctcttagcaaagttaatcaatcaggcccaatgttctatctgagatctcggtaactgtctctctttatccactgaggccatacagagaaaaacagaaattaaagccactcagagaatacttattttcaagccagtagcttctggcaaatataagccatttaaatacccaaggccctgtaacagttttattttttagctttgtcttgaaccatccaatcttacacaaattaaatactcttttgagaccactctaccatactagctattacaaagaagtgtcgtttttctattctcaaaactgggcatgggggagacattgttctatctcacatagagaagtcttcaagtcattcccatacaaattaaaaagaaggggtgttaatgcattgttctgctcaaaatgattagtttttcagatgtccatgcttgttccttttcagatatctatcatctgttgctttgaagccctaaatctcaaaaattaaaattcataccatctttgttccttctttgtttttgtccttctcacctctttgcaccagcccttccctcctgccctatttccctcctcaaccaaacttacctcctgtctgagtgatgacttgtatgtcacttgaaaggggaccatctccaattgaggtaaaagccaggactttgacagaatatgttttctggggcactaagttgccaatagtagtgatttggctgtcagctacattgtgtttcatccagttgttgacatgttgagtgggatccattgtataataaactctatatccttggatctgtccatttggctcttcaggttccttccactgtaccaaaatggtggtcgaactcaacattcgtgcctggacatccctcggggcactggatggtgcttgctctgaggtttgtgttagcacaggttcgctgggaggcccccgcccaatgttattgacagcaacaaccctgaattcataatccgagtagggacttagtccagcgacactgtagcgtgtggtcgccaccccatcaatttctttgtaaagttcctcagagtttttaggtttatgctgaattatgtaataagaaacaggctcagggttcccagagtcccacgtcagtgtgatgcttgtagctgtgctctcggtcactacaggagttcctggaggtttgggtaaggcttggatgggggaagataaaagacaatgactacccatcatccctataatatttcaaaaatctataaactctactatgaaaatgacaggattatgtatctactgaagatttaattaaatgaaattatagcaaagagtagttttctgaatggccaagaaggacaggaaaacattcataggtgacacaaatcctgctttcctagaagggcttgatagcatatttttaggcttgtatccaaatcctctacttattagctaagtgatcctgcacgcatttcttaacctctctttgctttagtttcctcatgtggaaatgggaaaaatattattatttaagtcatattatacagctgtatgtaactgtatttcatgggtttgctgtgaagactaatgagccaatccactaagattcttagaatgtaactggaacccacaaaaaaaccttagtattagctgcagttattactattattataccaaaagcttggccaattagccccttgccccaataaataaatggtataactgaaataccgataaacattgaaaagaacaaaatgtggaatacattgaaatgaaattaaattgcgatgaaacaataacatctatattctggtaagacacaataccattactaaaaattttcttgtaaatgaaaaaccaaaaattttaaggtgcaaaagaatagaaatttcaaatcaatgctttattcttaatatttaaaaattgctgaaggaagtaaattaaggcacattcaccaatcactttttaaggtatgttatggtcatattaatatgcattctatattccacatcagaaatatccaatgtagctacatgacaaatatttgcaataaaatccatctttttagaggtctaattctttctttttagcagaagaatacaaatcaaaatactactaattaaaaatataaactgtctgctttgctgacctcatattcaagtgccttattctaaacaatgattctgaaacgcagtgctattagggtaggaaggggcattctaatagttgactctttagagaaatctcaaagggtaacattcatataatcagcccattagtgtccctgtttccttgccaacataaaggcaagaagtataacaccccctagaatggcagcttttcaagagcagcaaacttgtacttctgacttactgtaaaattgtgaatgcctagaatgctgcctggcactcggtaggtttttaatgagaatcgttaaacagttaactgaataaatgagtcagcacccattcacctcattctcttcaacctgttcttttgttttgatttattttaatttgccattaagattcactcttatgttttatttgtttatttttgaggtggaaaagacagggaagtggcaagagtcaggaaaacaaagatgagaaggtgaacaaaatattagtttaaagtggcccctgcttttgaattcttaaaggtcttcagcaagccttcaaatatttaaagctgaaatggtaattataaaaaaggtgattcaatatttacacactactcaaagaactacagaatgatagtattttgtcaagggaatttactgaaaataataataaaatgaaatttgtttaaatattctgacctggcatttttcaaggctgtgtgtgctccagatttcccctacatgtctttctgaactttcaaagcaaatacaaatattgctaattaaagctgtgctcactgatatttagctgacattattagtttcactaagtcacatttattgtacagtacaggttttatgtctgtaatgtacggataaatacatgtgtgcttattatattaaggttacacaatataacattatttcacgattgtaaatgttgacaatgtgtacctttgttctcatgtcattagttttatatagcatatatttgatatatacgcttggttagagatgcgataccaattataacgtgtattgcattttctaagatcaccccctagaatggcagcttttcaagagtagcaaacttgtacttcttacttgctgctgaattccaaatgcctacaacattgcctaggaaaagaagataatttgtgttcattttgcaatagttctagccatctgcagaaaacttaagttgccctatgtctgactcaatttgcaaacactttctagaattctataaacactaggggaaaaaaaaacggtacccttacatgcttgtactctttctctttagttcaaaaatattcatgtaatatagtactttggttatatttagtctgttttttaaaggaaagaatattccttgagcactcatctatgcaaggtgaaagataaaactacaacagaatatactcttacttgccttttgatttttaatagtagggctcaccaaaaagttaaatcatctattactagactatgttgatttcaactttttttttcttctttttcctttgtatttagaaattttaagcatttattaatgctcatattgacttttcttggggttcttatcaaggttctggtctagtatgtagactgtacacatcagtcccaccataatggtcgaccatgtgtaaaattcctagttctgtctggttagtgcctgggcctccatggactgtcttttaatattctgatgattatctctacataggctgccagatacttccaagaaaaaatccgcctatctaggcttatgcatgttatataataccacagatatgattaggttatacacacatttaaaatgctgaataatgaattattttagattttcaaggatgggctttctagaggcattagtcacttggcttgagtgtacccagatcctcaaagcataatccattgagcatacctttgacagtgatctgtgctattgcttcaatgacacccagtgttgacatagcaacacaggtgtaatttgctgactgtcttacatcattcagttctagcacatttcttcctattggcatatcatcttcaggtgtcagatcttctgcccccaacatccactttacataaggcattggtgaccccacggccacacaggtgatattaacgcttccgcctggcatgatttcatgattagtgggtgggatagagaatcttggtgggacacggcgaactggaacaaaacacaagggaaatgataacatatacaaggcaagaaaaagtggattattaaacacatgacatgcaccgtacagacacgattcaacaattgaaacattgtggattgtccaaaaacaaaacataaagaaaaactgtggataatacagaccatacaagtatggtgtgtgtatacacagaattatttatttagtttagtcattgatatcttagacacactaatacaaaagttgattcagacctacaagggccccacaaaaaactatctacaaactaacaatacacaaacatcatgcataagataaacacaaaaacatatacatgcaggcatataacaatgattctatgcaggcatgtatatgcagaaaagggggctggaaggtcaccagcatgtttaagttgagtatcaaaaccaacttcagtgctgtgcacttccagttgatgtgaatgtaggtgtgggaccacactgtcacatcccagccctggaaaacatcacctagagtacactgaaagtgcactttatgttttcagattcatagtggatgcagcctcaagacctcacactaacactggaacaaacacagaaatgtatatacatattgatttacagtcacagaagaagaaacaggctaacaccagtagagatactggattgggtcatgcaaggcatgcacaagatggaatctcaaggcccgtgctaaggatattgaaagaatggctggaatccaagacagcaatgaccgcagaagaaataagggggcaatagaaataaacgtgaaagggggaggtaaagtataacgattgaaacacagggacttaggggatgacagggttgaaagacagaagattaagctcaagttgttaaaggtaaggattgcaaattcagaaagggagctgggtgtttcacatacaggattccattcaattcatatcaaaggtaaaacaacataaatgacaacaaaatcttttaaaaggctttttatgcccacattcaaattgagggacactggatctaaaacatacagcaggacatgacattaagagaagagatcatattaaagcaacataacacagaaaaattaccaagcaatttcagttcagtgttcctgcttcagataatctgcaggtttatgtgtgtttaagtaaatgtgttttggatgtgatacaaggagaaagtgaaagataaattggtttcatctggggcttttactggcaaaatgtcataccataagaatttgagatctagagggtaatctttagggagcacaccttaaatacatttaataaagattttttaaaaattataaataaactgataagtaacctcataaccccaagaagaagataagtaattctgtctgaaaactttttggctgctcttaaggtcgagataaacctccgcttatttgagatggctcactgcaatggcctcatgggtgaatgacagtcataggagaagaagagaaagctaagcatgcctcctgcagccaattcacagaggttacacaaagcaagcaggagccagtgtagactctgaggtatcaaagaacatatcaagaaaaatggaggagagtttagtcttcatgcttgggattaggggagaaactagaaaaagtcattctatgggcagcaggcatccttataagacagaaattaaaggcagggtgggagatggggacagtggagcaggaaggaaagcaggaacactgaccaagttcactggaccttacagagttaagtgttaccagttaccatgcacccaggtacattctctcccaccatgcaccacagttagataccaccagcaagcaccagaagccatggccagggcattctctgctaaaacataccattaaccaaaagaagaacacaatgcagctacattcatttcatttgtattctttgttattggtttaattaatagttttgtaaggtgggtaaaaagtaaaaaacacaccaaccttctcgcagctctgagggatgtagggggtttgatgcagaacacaatgaaatgaggaaaggagaaaaacaagggaaacacagagagagtaaaaaggccatatcaaggctttcaactgctacttgaacatctttattcgctctagttcatccttcctatctcagctggaaaagttagcaatatctcacagactaacatggtattagaaacaatagctagcatcattttgaaattttccatggaagaaggtacacatgcctcatgcagcaagggaggtcactattgtggaaaaaggatcaagggactttcgaagaatttagagaagaaatgactttcttcatatttccccaccccagactccataaaaaaagaaaggagagaaaaacatccccagggaaacaaaattacctctaacaaaaatttcaaaatcaagctaggtattttcttaagggaacccatcctattgtaacttaaagccctctcagtcttttctttaatcccacccccacccatgcctttgtggttattcacagatatgtagaccaggaataagaacacttccactggataaaaaaaactacaggaactggctttgagaactctcgggaagaggaagtacttctttctagttgaatggaaaggcatagccattcataagctcacagtttaatcatttctattacttcatgagaacatatgaatgtatcctcataattcattcttgtctcaaggacaactcacattactatttaaaatacagttttccattgcaatcaaaaaactaaatgtttcggtaagtcttaataattcaaacaaaaaggtgtacatatgtgcacatatatgaatacacatgtatatataatactatgtgtttataattaagaaagtatacgaagacagaaatgcaactgtgctatttgcatgtagcacttgttttatagagttagcagctttatccttacagtttcagcagcaggggtcatgaagacataaacacctttatgcttggaattgcacagagaactgattagtagcacaccaagcaattatttcaggggtttaataaggaaacagaagagaaacaacagaaaaaaagagaaagaaaaagaagaaaacctcaaacaaatgcaaagcacagttcaatcaatacagtaaaaatagaaaccaagatgtaaaaatgcaaatatacttacaaactccaagcctcaggacagattatactcaagagttgtcttttggagttaaacaacacattttaaatttttaacttttctatttactaacatgtttcagctacggtcactattaccaaaccagcttgttaactactaatataacaacacggaccctgcggcgtctcaactccccctgagcctgaatgaagaagcgatgccagggttatgtcattcctacctctgacatataaattggcaggagcggaatagcgagtgcccgcgctgttggtggcaacacactcatattttccttggtcagactcttcactctgctcaatctgaagggctcctgtatggatataaaatatattgccaaagagatgatcagagaaggctttctcagttcagaaagctaaacctcttaacaatatgaaaagccctgcaaagcgaaggtccactcaacgtcgattcaatctcttgctaagttgcacagacagaaaatgatgcgatgagaaaaacatatagagattattttttttttttacatcatcaatgctagcattagaaatcaatatctcttttcccaagcaagacttctagtcataattaacactcttatttcctagactaataaaatgaagatgggtgagactgcttcaaggaagtatggcttttaaataaaacaaaagattaatttttggttttgttttgtttcatttgggtaccaaaagtggcgcaaaagataggtacgctcaaaaaaaaccaggctgggttttcaagaaagtcttctgctgaagagagccaaaaatacgcagcgagcacaaaaaggctgcacaaagcaaaaaattaaaattagtcattataaattatcaaaatatcacttaaagaaacaaaactcccttaagacatgcagatttttaagaaaagaaagacagttttccacgacttacaatcatttattacgtttgctgaaaaacaaagagcagttgaattagaagatttttaaaaagttaaaaggcatggcctgtgccacaaggaagagccaaccaaccactgcttgaggaccctgagatggatcccctaagacacccatcaaaatccaccagtgggattagcagtgtggtgtcacaaaaccccaagaaaaatacaaaacaagaattacaaaagaaatgcacactgagtcgaagtatgaaaaaccagcaataccacataccaccaagaatactgagcaccttttgtttccatagcctgaaggacagaagatccaaaaatccggagacgagtaatccaagaaaaaaagaagtggggaaaaaagcattgctgtcagattgtagacgagtgggatcaggtggaaaggggagtcattctttgacttttaagacattaagagaaaaaagaattgaagaacaaaagcaaaaaccttttgaaagataaagacaaaaagcagatgctccagggtgtcttctgcatgtctgccactgttctccagaccaccttggctttggtccagaacaagaacagctaaggaagaaaaaaaatgatctttttttttctccggttggacaaaaaaaaaggaaaaagaagaaaaaaaaaaagaaaaaggaaaaaggaagaagaagaaaaggaaaaaaaaagagggacagatggtacgctgtgactggtctgtggtctaaagacctggatatgctttctttgaagcatatcacaacttaaataatcattttcataaagaaagaaatgaacaaaacaaagagagaaagaaaaaggaaaggaaagttcacaatatgagagtcactgatcataaccaaacagtacaaagaaaaaaaaaaagttgatggacattattggaatgacgctgaaaacaggacaaagatgagagggatgaaaggacagaaagaatgagtaagatcattctgtgaacgttagttcagcactcttacctcttattggtgtaccacctgggtggataatatgaatgcaaataagattagaaagaagaagcattagtacgagaagaaggaggctagggctggggagaagaattaaattagatttacagaattaaataaggtcttaaaagaaacttgaattactatattggtaaaacaggaatatattagatagtattattagatcataaaaaacaagttgcattataccacagagggtaaagaccgcaataggcagcattgcctttctcagagaagcaactgagttttcaggtctggggtcatatagggttagaattatatcttatatgcctcatatctcttaaaaaaaaactatacaatatttttaaagacatagtttaggaaaatactggctaatctatttaagtatatatatagatatgcatatatatatatactgtgataggaaacactaaagactaactggaaacaaacattgttgattggatatcttatactacttgctatgctacattggtgtgccataacttgtgtactatttaatttttctgcacagtgttcttacgataacagttctgtggaggtgtgtgtgggagccactacagagatctggtgtctacactgacagttagtaaaatgcatgccatgcattttattaataataataataatattctggatatggaaattagtggggttgaagtgcgcttcagaactaagcacttaccaatagattctggagatttaaatacggagagaagaaagacagcataaaaatattattatattccttataatttggtacaaatttttcagagttaaagctttatatactaaatcatctatgttacatgtgaataattaattcttcatttacaataacagaatgctaatctacacaattctgctgacaacaagcaaaagaggcagttaacaagacgctttaacatcacaggacaggtcaaaagctgagaattctgggaagacaggcagttaaacaacttagaattctataccaatattactaccaatgtcaaagtaaacagcttattattatatatccctgtgaaattacctagggacaggctctaaaacttaagaaatttagaattatctctacttttaatctaagagagcaaaggcataaacttgggatgggaatgggaaaaggagaaaagggtaaagagagagagaaaacagcaaaagctggagtctacaccaaaagcagacttctgtagatccagtcactggagggttcaaaaaccttgacgggcgcacactactgtggctaatgtgtagaaaatgttcactcacaatgttattatcatagtattaataaaaatcccctccttttactggtattttctaaagacttttaaaaacatacatctggttactcatgagataacgtttctgtgtttttatgtattagtgaaaagaaagcagatgtgcccagacttactaaactttggtactttgatgagttcaaatgtagaaaagatagcagaaaacatactttaataaaattgaaacattttagggtttaatatgaacattttattttttaatggatacaaccattggatctccttgcaagttctgaatgaagtccaatgttgaaataaatttgtttcaaaagaaaacagagaaagaagaaagaaagaggagaaaatggatccatcaaatactgcgaaaaagcagtaaattaaaaaattaccaaaaatacagtcacagcagtgagcaatgtggattaaacagaagctgcaaaacacacagagaaaaggagaaagacagactctgaaacaggctatgacatcacaaacatggaccacccattaagtaacagagaaagagaagagggagaaaaatcagtacctagaaataaaaaataaattaaaattaaaaataaggagagagaaaaattaaaaaaaaaaattctctaggagttagtagaaacagtaacaagaccctacctgatcgtaactgcttaatacgaccattgttgttgcttgtgtccacaggtaagaaatctttaaaccaagtgatttctggatccggattaccactggctgcacaaagcatggtggccgtgcgagtacgctcaaccaccttcaactgtgggcccatgtcaatggtagggaagcccctgggaatttgatcttctgcaagacaaaaggtgatagaaacattcagttaataagtcagatgctccaaattcaagagattccccagaaatctctctttaccttactcagtgcttgttgagaacctaacacaaaccaggcactaataaattagaacacagtcacaatgctgctactgatcagaagagtaaacactctatgtaagaggccaacagactaacacagagctcagacggggccgactatgatgaggggatgcagtgagttttccaagagcaaagagggagaaataattatagggtttgtgcttgagatcagtgagtacccagaggaagctctgatttaaagtaggcatttaggaaagaacacaatcggccaagtcacaaaaaggggagaaggagattttagaaagattcgggaatgtcacaagtgtaggcattgaggtaggaaaggttttgccgagagagaagcatggaagccaacagtgccagcttggagagtacttggggaacaagcagaagctaggtcacgctatctgtttcaaagctggtatgtttttcttataactctgttttccctcacaagtataaggttcaacccaaatcgattactttgtaagagcttcaattaaccagaaaattgtctgaggatgctttgaaaaagaagagcaaaagcaactccttattaatggcacaaaaacacatgttccttacagggataagagaatgctttcctccatcccaaagatctgcatcattttcagtaattaaaaagttgaaattcctaaattttgaatctccaactcatgcaaaattcactttttgctacccacatcgaaactgttccagatcccagctcttgagaaattaaaatcacttaaatcccacaatcatgctccacactgataactgacattgccagctcttctagccaggattagaaaggtgtgttctatctaagcatcgaaagaattttagttagatgggtggcaattatccaaattagaacatggccatttgtttgaagatcatgaatttttgttattatactttaagttctagggtacatatgcacaacgtgcaggtttgttacatatgtacacatgtgccatgttgatttgctgtacccattaactcgtgatcatgaaatatttttacttccaattgagtctggcattgatttaatcaataccccctcacggccactgataaattttcataagccaccaattctaaaattactcgaaagcataaacagcagcgagcagaacattagatatcatcagatctggcatatcgcttctccttgggtgcctcctacaagctccagtataatccatgaattcacagttgatggtgaatcatactgaggttatgttagaatttctaatgaagaagctccattttgatgcctccaccgtgttgccagtcaacagcatgtgttctccaactctctccctctagagccgaggggtaaactcagtctcctaaacctcactagcaaagtccttttcaatcaggtctcatttttctcagcctcttagggatcaactctctcataggaaatttttcttctgcccacattgaaattctcaccacttcccagacaaatcatgtttgctgggtactccgtgcttctaggaagccacgcagccaaagtcaccttctttgtaaatcttttccaaattctctcaaacatatttcattctttcctcctcagagctaccatagcagcggctactcaaatccactgtcttgtacttattaactcatgagtttatccctccacaccaggagttcttccatgttttatctgtattctgctcccttgcaatcatgctagcctgggtttccagattttaagagaaactccactgattcctaagcctaagtatgaatatatatcagtgactgtttaaaaaatatatatatcctactatgcagaacttctggtagagaggcaaccagttaaatagttagggaccagagagattctgaatgtgaatggcgaaagaatgtaagatgctaccaaagattaaagctcccaagaaagagaaatttcactgaacagatgcagttattgtaagataaaattgatggactattaaggaaaagcgtagactctggctctcccgctgggcaggatagaaagtttctatcttttactaacacagtctgtgaaggaccaaaagaagctgaggcaagtttgatttgacacctgattcatgacataataccttcctatcagaccaggtagttagggccgggtactaaacacacttataaaaataattaactgcaatgagctgaacttcacttaagttgaaagatgtggctcatttgtggaagcagtaatacattgtttttgtgaatgtttacacatcgtcagccaagcagaggtctacagtagacaagtgtcagaaacagtagttaaaaattgaatttcaagatgatttttcaaggctccaagagaaagttaaaaattaaaagtgggatgcaaattaggctatgctggttttaataatctattccacatgaatttcatcaggctgttctttatggctttaaaggttttgccaatatatttacatctacaacatagttctgatgttgctggggggaaaaaggagcagaaagatcaatagctgctataccacacacgttatgttattaaatatctcacttggcagctattgacacaaagtgcttcaaaggataaaagtaatttacctcaagtgctccaacaccaactataccgccttcataaaaatgagtttctgaaaaagctcttagattttgttgttgttatgttccatttttaaagcaaccaacttaggttaatcaaaaatcaccttgcgattcctgagtggtttctgtatgtcctaggacactgtatctctcccatggtgtttaagtactagttacatttgcctgcataaatactgctctgctagtcattacttttcttctacaagttcatctctcggaagaactgagccaatattcagtgctgatcagtggcaagtgccaaaggcttaagattgttaagccacttactaaaggctcttaccaaagaaatctagatttaataaccgtttataagaaatatagtcctcaccttggggatagccgacaaaattgacttgtaccttcctgaaaagcagtctaatacattttcatgacctttctcttccttcctggctcataaagaacactccagagcccccttttcatatacacgagtgcacaacaaagataatctttcttgcatactaatgggacagaaaatgtaaagagcgttcctttcttatttttaataagggtaattaaattctatccatccccctttgcacagaatctctttgaatgcactttcttcgttaaattttcatgagaaacatcacaatgtaacagattcaaatagccagagctgttacacgttgacagttgtggcttgtttccaatttgactgtcaggtatttggcaataaaactcagtattcaacataaaacaaactgtagaaataatgaaatttctaattggaatgcttatctccgtgggtgtagtttagaagacgttaattgcttttttcttcaccttccacatttattagtgatttatataaaactgccttggccatttgataacatcaattttgacggctcctcaaatgtgtggtaccaggaacttgggaatcaaatcaatatccttaataacttaaccacacaaactttcacaggaaaaagcagctagcaaaaattaacaaattgtcaatatgctagtagctttaaacttttacatgaggtgaaaagaaaaacattttgtcctattcattaatgtgctcattaagctttaaagtgccttacttatcactgttccatattaatattcaatcatgcagaattagctactaattcatcaaccatttaaatcagacttgaccttcacaaagccatttgttctgtcattttgagaggccattaaagggcagattactacatacttgtgcttagtgaatcatagagtcatacatattttgtttggaatggcagctataatagacctggaaatatagcaccctctttgaatctgttggtatcttaatgaaatatgctgatacaaaactttcagttccattaaggaaagagaaaaatgaatgtaagcatcttccagagttaacttcccattgtggtagaacttattaacaaccctgacctacccaggacttgaaaggaatgaatccatgaggaaaatagtctgacactgttttgtaggtagtcatgccttacatatctgtgaatgatcaagtaacaggttttacatgatttgttcacttaaactgttttcactgttcatgcataaacaatattaacgatgctcttactttcactccactttcacaaacactgaatctcttctttgtaaggaagccaggaaaatctgaattgcctgctaaggctacaggctccttccaaggtggtcctaagtagctcttcttgcctaatcttgctagggctcttgctgcgtgaattcaaccagactagtcctttgactctgaccccaactgatttaacgaagtcttcaataaagaactgtttgccatggtattgggaaaaatcccaatttttaagattaatacaaatatgtttataaagaaaaagcgtgtcaattacatcaattacatcaatgcttcttcaagtgcagtatttaaaaatttggcaagtatacctgaacacttagatattattgacaatacagaggttttggcagtaatggcagtacaataaaacaaaaacacaatatggatgaagagacaagcagctgttatcatgaagcattcatcccctggaattacttttctaagtttcaaacagttcagagtggctcctctttaaaagtccccaaatagtgttatcaataaaccgtaataatagttagtatgtaagtgtgaactcttacaagctcacaggagggcaggagctatttgttactttcttcgtaaccttcccaatgttcaacaaatactcacaattagacatttttatgatgctttgacaattactttttcagcactcactcatgaggtatctctcaattcctcctggaatgtcattcattgaaataccattcctcaatgccactcactgaaacagtcattcttcaactgtttgtgactacacatttggcctccttgagtatcagtctattaagaggcaaagctatctcatagtctcattattttagtgtcataaggagtattagaattagagacttaaaaaatggctgtttgtgactttattttcacaatctttagtttcgtcagcaagtgattttccttccattgagaatatgcaatttatgcttttaatttatcacggttgctatgtgagaagcacacaatttagtccttgcttccttcattttacaggaggctttccctcatatattggttttcagttcctacgtgtcagaagcatgaccacatgacaaaaccacatgtataaacacaatgacactgcaaagaacacaatagaacacgtatctatattctactgttattctatctatagaataacaatggaattcttggtgttgaaactaatggctaaaaaagcccaggagtgaaccactcagtttttttgttgaggcaaacactgtgggtcttccttcactgacaggaatacagatttctaagtcactggatatcttacggtttgagtcattcatatactctcacagaacaagagtgatttcttttctttgacgggtggaaagactgagtgagaaaagttttcattaacataagaaaacaagaaaaatgatagacgagtaatatgcagcgtatttttaaaatgacattcctagagtatatatatatacacacacacacacacactaggactgtcattttaatatatataatacatatatggactttttcacgtgtcagagaatcagtagtgttctatgcagcagaaagtcagtggatttttatacttaagaaaaagtacgaactttctcggaaaatttaaatacacattggtcttaaggtggtcaaataaggtggccaaatagatactttaaaacaagatatttatgaaaattacaccatatattgaaacaagaagataatttgaactattagttctaaaaacctaccggatagtcaacagatggcatcattcattctacaaatatttattgaaggcctcctttgtgctggactgggccaggcactgggtatgaagtaatctagataatctctatattgttgtgatttaattgtatctgcaggataattagcttctttgaaagtaataatagtaccaagcacatacacaggaagattgaattagatgatgcattaaatgtgcctagtgctgcctggcactagtgtctggcatctagtaaaatactagcatatatgtacttgctttattccaagctccatcaatagatctaaagggatcagaggcatgtgactctaaggcttgatcaaacaagtagtgcagcaataaactgcaaatgagaaattattctatgcaaatcataaaaaacaggggttatctagacacgcaactaaatttaaagcatagtgtttgtgccaagtaacctctgcaaagccaataaataccctcttttccctttgaacaagattttaggctctttgattaatcaacagtacaaataaataaaatccatattgtcagatgatttgttcctaaaaatgaattttaaaaatagctctaaatatttgggatgtcaaaggttgttgtgaacaactgaaaacactggaaccaactgtttttccctatatcatggcaggcatttttcttttagttattcagggaaggggcattaagtattcctcatcttggggagtaggtcatgttaagaaggctatatggctttcttaaagaaaatagtttttaaaaagatgatgccaagaagtcagagttttgttttttcatctcaaaagtttcttaacattctgaaaataactgtttggggaaaatgatataaatcaagaaacacctctgtacaaagtctccataaactagttctaatagctccattaattgttcagctctggagaggggaaatctctcgatgagatttgtctaatatgatgctcttactaaatcccacctttaacagaatggaatttagtcagaagatcatattagacaaatttaaaattttacctaatgcaaagcactataatgcccagtatctctaaaatacaaatatttgaaccttattagagttccttgaggtaaataaggatggtatcattatcatttttttgtggctataaaacaaaaactcagtaatattgttatttgtttcatatcctacatgtagtaaaaaattaaagaaagtctttcagctctagatttggtgtctttttattgtgtcatgtttcctctatgcaaattgctattcttcaaataaatcttcatcatgtagtgatgaaactcttaatcacagtcaactcatgaatgggacaacaaaagagtttgaatacttggtcatcctttacttttattttttaaatggcatggactagatacgcaagttccatgagatgtaataatactttaaaaatagatctacattttaaaaatccacatatatatacatacatacacacacacatatacacacacatatatacgtatataaatgtatatatgtgtgtgtgtatatacatatgttataggcttctcattccctcaggattggttctagaagagacagaattctgccatgtctgttagccagtacaaggtagatgagaaatggaagagtgtgaaaaggctgataaatgtcaagtaattttcctagagagctgagatttagtactgtgcctatacctttagcccttctgtaatttctacttaattacctaggaagggctgagaatggcgggccttctgccatgagcaggcaccaaaagtcagtacagagaccagaaaagcagatataagtagacctaacatatctaccctatgactttgggccacaaggtccctcttcggtttatgggactaataatgactactccaaagctttatctggacagggagacagatcagtgtctcagaggctggaaggcagaggattatcatagtgtatttgctactttgtcgaacaatgagttttcaagtcattacatttcaaaatgaatcacagtatcaggctacaaacaaggaccaccattttctttccagaatacagtccttgaagaagaggaaaaaacattcttttcttaaaggaaacagtgtaaataaagcttttattttcaccattccagatggcagcagggtataatttgtactgtgttgacatcatgaccattattattcaaagtcaattttcctgtaagtgaattgaataagggactgaaaacagaaaaataaagagcaaagaaataaaagctaaatcaccgttttctagcaaagttgggctcttgggccattatcgaaatgttacgcatatgaataaaattgaaaaaatcatatagtttctaattacaaatcaaatgctagtccagtcagcaagaaactatataaagcagaaaaaaaaactgacagttaatacatgacattccaaatggaacatacgataaatataagatctgttcccaaaaaagtaattatgaacaagatacaaaaatttttttcccaaggtcctctttgcaagttattacatacagatagtatgcttgtcttaatatggctataaatcaatcagctaagcttttatttcagagtagatttaggtatctcttaaaggcagtcactggatacaagagtctcgaaagatttctcatagaattatgccatgcaggaatagaaaattggacattgttaagctaagagcctcattagcagctactaaatattcagcataccaaccagctacccacagagcattccagagcaaagctccattttatgaaatattcctcacattttgaggagtttgcaaggtactccgggcagagaataaaacaaactgtttagaagcaatgcatgcaatcatcctacaaattacaaagtaatgtctacatagcagaacataaaccccagttagatttaattatcatttgtctaaatgtggtagctccaagtttacattgcattaagttaaggcatactgttattagtgctcggcctgagcaaatgattaccctttttgtgattcataatcaaataaacgcattgagaaaaaaaagaagtaccttctcctcctacctagtaacactattaatacctgaacgtttaactaaatacttaggcatcagggaaacacatttattcccttctttgggattcatttagataaaatccaatatccatccactttcacaaatctcattattccctatcaatttatatttatcaacaagcaggtgtcattatactcaccctttacatccatccaaatgtttaccttactttgaatattcaaataattaaccactttaccgaaatgtatatttaaatcataaaatgaattttattatttttagaaaataattttttattcttgttttttagaaaaagaggcacaaagacaaaaatagtaaacaaggaaagagacttggatttggatcctgcatccattatttgttagctttgtaaaaagttacaaaccaacaagctcaatcaaatgggactacagaaaacattcaatgtggtttcttcaccatattttggtaaatataagtatatatgaataaattttctaagccatcaaatgttataaaaaaaagaaaatcagaatcaattgtgtagtgttggattggaactaatagtgttggtgtgaacacctagttttaaatatatatgtacacacatatatatatacatttgtatacatatactatacatattttaaatatatatgtatacatatatatatgacttgtaaatgagtatgcatgcacaaacatacattctttatataaacttagcaaagacatcttccctagctgaaccaagagaggctgggagcagtaatacccagtagcaatggtcacaccttgtattcagatcttggtttctaaataccattctccagttgaaaggaaacactttcctttcagaaagcttcccttcagaaaactccttagagaaatcactgattccaattaggactggaacaagcaaagaatgagactggaacaagcaaggaatgagaacaagcaaagaagacacaacttatcctgttgtataagaaaatactcaaagaatgaaaggtatatactaaatgtacacagaagccagcttaaaggggctcttattgaccaaatattggacaacttgaacacgaaaattaaaaaagacagtattaacaagttataacacactgaataaaataaagacatgcatccatactgatataaataactgagtaaattaaaagtttcaggagaaatagtatctttacatagtatcaaagggactccctacataaatttattaaatataaagaaagcagtctgtgagagattaaatgatagggaaagtcttaagcatctcctagatttgcagtatgcaattagaaaccaaaaatgatgctccttatgctgctgctgatgccaatgatattaatttagaaaataatgctcccatttacatgattttgctgtattctaagcacggtagtagtcctaaaaataccattaaagacaaataattttgaagttttaaattttaaaaattttaactatttttaaaataataataaaatatgtaaagaaaaattagtaactttacattggagaaggcttacagaaacaaccttgattaaaaaatcaaagttaataacaccagtaaagggataattcaaattcttgtgctgagaaaaatataacatcacttccacaatattcctggaaaagagtcacaacctaaatatgaccaccagtaaacatcagcaaaaccccaaacaagaacattttgttaaataacaggctcgttatcttcaaaactatcatggtcagaaatgtcaaagaaagactgaggaactcttccaggttgacaagtacaaaatacaattctgaactggagcctctgtggaaaattataaaaacttgaatggcgataactggtgaaacacaagtaagaacaactggaaaaatgtgatcaaaagtgaatgcggatctaagaattagatggttatgatgcatcagtgtttacttcctgatttcgatagtcccattgtagttaggtaggagaatgccttgtttgtataaatctgagtatttgggaatgacaggcaaggcatcatgtcggcaattaactctctaacagttcaggaataataagttctttgtactgtagtttctacttttctataagattgggatcatttcaaaattttaaattatatagaagtaaactgttataattaattcatattatcagaaatatatagacttattcccaaagcatctgggtagctagatatactcaagcattgctttcccaattgtgacaaacattcttaaatatatactttatttgaggccctcttgaataccatgactatttaaatgacactccaactgttattaccaatttcacacaaatgatgacaatatctgaaaaaagttaactctaaaaatacatgaattcctataaaattaaggcataagtatttaattacaaacaatgaacaaaattgagtgataactcaagagcaaggtgcaagctcatgaaaagaaaatgtgagaaatcaatattctaataacataatgcacgtttattatttttatttagagaaatgataaagtctgataaaaatttaagatagaagacaaactttttgaggatcttccttccaattaaaacataattaacttagaatagcttcagaaatccaaatgttatttttttaagccaaactttcaaaaattttagaaacaatccaccttcccctcagctcatcacagttctctcttcctgaaacaagaacacattacagaaaatggttgttaccctctagtctttaataatgtaaggcaatgggagcaagaggaacaaaataaagtgactcagatatgtctaaataatttttctaaaaagagcatttcactattttaccacattcagtaacagtttttatagttttaaaggcaaactgtggtaggtatttgttttatctgacaggagaaaattgattctgaaaacagaggtaatggcagttttctttagagggtgtcttgaaagatgaaaagatcaaaatcttaaaacatcaaacatcacatataaaatgtttcactgaaaaaatgaaaactacaggagtacatgaataagcagttaaagataacttatatgtctcagaatgtattacagatctatggggaaacatttcccataaatgcaaatagttttctatttatatggcaaaattcagcctgaatttaacaccagagaataaccaaatggaactaggttttttgttttgctttttatagatagggtcttgctctgtcacccaggctggactgcaatggtgcaatcatagttcactgcagcatcaacctcccaggctgaagggatccttccacctcagcctccagggtagctgggactacaggcatgtgtcacaatacctggctcaattatttttatttttcatagagatgggtctcactaagttgcccaggctagtctgaaactcctgagttcaagtgacactcctgcctccactctggagcagctaggaccacaagcacataccaccatacccgtcttttcttttattctttttgtggagatgggtttttgctatgttcccagggctgctctcaaactcctcctgggttcaagtaatccttccaccctggccttccagtgctgggattaccagcatgcgtcactgcgcccagcctttgtgtttgtttgtgtttgtgtgtgtgtatgtcaatgtatgtttttcttcaaaatctttgaaatcacaggactatcaatttatgaaactgcccaaagaagtttacaactatgatttatttcttttcgaaatgtttgaactttcctctctatcaaaagaatatcatatataaaagcaaacacaggatagaaatttattcactatgctttcaaatatcaaaaatattaagaagctattcaacaggagttcagacatctggaaaataacccaatcaaagtaaaactgccaaacaatggccaaaaccactaccaaaagttacatgaatgaaatcccttatcttttgcaactagatggaagagttgtcaagcatccacataaattctaaaaccttgaccttcttcttcaatagattaaacacagcaaattagaaaaagggtttcaggcaaaacctgagggcatacataaaggattgcgatctttttccaaaagcaaatgaaaggaaagaagggttttgaaggtaaatacaagtgtgtgggcacttcggtgcttgcgggcatgtgtactgggagtgtatgtcgcttatcacaaaattggcattaaaaaatggctttttaactgcattatgaaaaatgcattggggaaaagcaaaaaataagaataaagtgatgtaggcatgttatttaggatagtaccgagatagccctgtggcaagataaacttacattaggaagatgtaaggagatagggagaagtggaaaaagttcagaataatttgaatgtcaattttacaagggttggtaatattttgaagatgaggaatgaaggagaattatcagggatggctttctgaaatgttatgattgtttgcatatgttttcagtcatgtcttcccttgggaagcaatgtcatgtatttgaggcactcatgaaacagtatgcctctatgaaggactctcaccaatagagctgcccctggatggagcacagcactaagtacaaagcaagtgtctgtcagttgaacactgatccagcttttccttcaggaattggcaaaaggggctcgtagagcaagccgtttgcctccttatctgctttgtctcaggatgaaggcaagaaatgtctgcttcagcctacacacgtgagctcagcatcctcactacagacgcaccagaagttccctgggagccagtctagaatgggttgtaaatacccatggatttgcatcagttttctccactaatagctcaattcctgcaatttgaagacagttgagcatgcaagggtagtttctccctagccagaaaaggaattcacaaaatattagagtatgacagccaatggtctcctgaataagaggaagaataatttgagttgtgttcctatgaagacatgaaattaagaatctccttatagataactcacggctgtcacattttaatatacaacatgccaattaaatagatataagtttccaatgataagatgatactcagaagcgatgtaataaaacctttttcttacatattgaaaacaacccagagctgctcattttcgtttagttgtaatagactgacacattgttataaatttgggaaacatacaatctctaattcttaacaaagtgacagcaaattgacaacaaaaaaagttttctcagccttgaattcactggcatagcaacatgacataatccaccaatcccccaacagccacgagtggatggttttgatgtttaccacaagattaatgccccttcaattgctcagtgatgatggctatgaggctgctgaataaataatgtatgtgcattcactaaaggaaggaagaatgtgtatttcagccactgatccctaatataaccaatgctatttaagtgtttgttgttaataaagataaaatactatgcaatacagctttgtatattatacacgacaggttttgtgagcaaattatagttacatgggcacatgttgtcatttttccggaattaactcagaagataaaatataatcaagaatgtttccccagtgggaaaaagacattttcttttcctttttttctttttgagacagagtcttgctctgttgtccaggctggagtgcaatggcatggtctaggctcactgcaacctctgcctcctgggttcaagtgattcttctgcctcagcctcccgagtagctggactacagctgcgtgccacaacacccggctaatttttctatttttagtagagacggggtttcaccatattggccaggctggtctcaaacccctgacttcatgacctgcccacctcagcctcccaaaatgttgaggttacaggcatgagccaccatgcctggccaaaacattttaaatttagttttattttcatggatatcatagcccaccatagtactggtttttgggggttgaaggttcatagacttccatttgctgggaacctattgggtatatcacatgcattaggctggtgcaaaagtaaggttttgccattactttttttttttttttttttttgagacagagtcctgctttttgcccagtctggagggcagtggtgccatcttggctcactgcaacttccacctcccaggttcaagcaatttgcctgcctcagcctcccgagtgatctcgaactcccaaccctcagtaatccgcctgtatcggcctcccaaagtgctgggattacaggcatgagccaacgcacccggtcgccattacttttcaatggtaaaacagcagttgcttttgccattgatatgagcaggaattaccttgcaggaaaataaaaaaaataactttttttttttttttttttttgagacagagtctcatctgttgtccaggctgaagtgcagggacgtgatctcggttcactgcaacctccacctcctgggttccagtgatcctcttgcctcagcctcccgaatagctgggattacaggcgccagccactgtgcccagctaatttttgtatttttagtagagacagggtttcaccatgctggacaggctgatctggaactcccgaaccttcagtgacccaccattgtcggcctcccaaagtgctgggattacaggcatgagccaccatgcctggtcgccattactttcaatggtaaaacagcggttgcttttgtaccaacttatacataagttgcatgatttctcacagacttaatcctttgacaataacagctgggtcatactaaagacagtccttttttttttttttttttttttaattgtcaggaggcacttttgtatcaaagtgccttcttcaaagcttaattcactttcctaaaacatgatgaccagggtttcagaacaaaactttctgggatattcactttcctggtgcttcttaatatgacagagacttaaacatattctagcacacacaatcgtagtttttaaatgtttatcttggttgtgaggaaaaaatgcagctagtggtagatttaacaaacagcacattgctccactctcacctctcttttactctccagaaataatttttgttgattttcaaattcatttcccaacatcatggatattattcgttttcatacttatattttgtccttgacaaagataatattgtttgttcagacatacagggacccatttctgataattcagtttttcgtgattccaaatggaacctgtaacagagttaatcgggggtacctggactccaggatccctaagttcatgagacaagctgttttctggattattcttctaaaaagcagatcaaatggaaaacttctcaacaaaattatttatgaattgcaggacatgaggtagttccgaggaaaaccatgtatcttgataaaacgtataacatttcctagaacagagtcaactatcactgatttcatcacagtgattttcagaaggcaaggactatacagatcaactgttttacagtcaaagtcatgctctttggtaaatattctgaagtgtttgactattttcaataactgagtctacagagacattacctcattcagtttattaaagtacattatttctactgattgatcaccattgaaagttcaaatggtgtttaaaagggccttttagctttaagttgaatgaatgacatggatacttgtttataatttcataatagtttttcaagtttgaattattatagacatactttatggtataaattggtcattccttaatttcccattaagcctgttcaagaagaaatccaacaaactttatacaaactctagctaaacgtagaagtgctcactttgtccacctcaatttatcaggtggctagcctatccaagcacataatatcaccaacctctttagttttcataagaagatgtacctatttagccttaacacagatcagtggtaacatctgagatgcttcacttaaccgaccacatagtgttgctttcatctgtacttatcagggatctcaatcttaaaatgacagtcaaaacaacttggccagaggagtaatatttatggagaattagctgaagttatgcaatttcatccactcctccatataatataaaaactgattttggttagctaaaggatgagagagctagaaaccaggactgttttctctcatctgctggagaacagattaaactgacatgtgttttgttataattcgacagattaacctgagggactttagcaagcaactgccctataatgttgtgaaattaaacatgcatatgatgcagagaatagcatttactatttgactatatcctcgttctcaagaactatgggagagaacttttcccctggtttcaggggaatattatggtttttctttcttttttctttttcttttttttttgtgagacagagtctcactctgtagtccaggctggagtgcagtggcataatcctggttcactgcaacctctgcctcccagtttcaagagattctcctgccttggtctccccagtagatgggattacaggcgtgcgccaccatgcctcgctacttttttgtatttttagtagagatggggtttcaccacgttggccaggctggtcttgaactcctgacctcaagtgatctgcctgcctggagcctcccaaagtcctgggattccaggcgtgagccaccgcacctggccatactatcatttttctaaagaactgatttgttatttatgttatggacatgatgcatctgtgtcacagtttccctctttctcacgtctagagatgttagtagatttggagctaaaattgtggtttatttagcaaaggcacagaagtccatggcatggaccgtatgcacgttccaactatactcctaacattaacctgtcttactacaaaattttcctgctccactgtcataccattttatcttgctatgtgaaacattcctccataaactcttctatctctttgaaataaagttatcatagacacaggcataaatattgtagatacaaccttttaaaaatatataatgtacaaaagtgatgatctgaaagatgtcagtacatgtccaaatgaatccacatttcccataacagtctgagaaatgttaaagtcacccaaagttatgctaaaccaaaaacaataaacttattaaagtgagcttaccagaaaggatataaaaaacttaatttagtaaacactaacttaaaggaaaaaataaaggaagaaagaaataaagatagggttaaataggcatagtgggccaggcatggtcccagcactttgggaggccaaggtgggcagattgcctgatctcaggagtttgagaccagcctgggtaacatggtgaaaaccagtctgtacaaaatatacaaaaattagcctggtgtggtggcatgtgcctgtagtaccagctactctcggggctgaggcaagaaaattgcttgggcccaggaggttgaggctacagtgagccgtgttcacaccaccgcactccagcctgcgtgatgaggtggaatcctatttaaaaaaaaaaaaaaaaaaaagagagtgactattatttctattttagaaaagtcacaggcattggatttaattccaatatcagcccatgataaaaatgataaatatcacaaagatatatacccacacaaaaatacatatataattatgtgtggatatgtatgtttgtacaaagcacatgtttacattacttgcagaaaattataatcacatttaacaaacattaaatagcagtgtattatttgttcaatttaacaaatatttattgaacacctctcagactctctgtgtaaaacattgctcagcacctgacagctgcaaaaacagtcccttaaaagttgtaccatgtaaggtgaaaacgtgcatgtgaacacagaaaatgtgtcaactaatcaaaccctaagggagcacaggggtgaataacgattttgctggagaccagagaaggtagatctaagagcatgaatataattttgatagaaatgtagtaaagggccttcaaggcacagggaaaagtataatctaaggtccaggaaagattaaataagtgcgaggtggattcaaggtgaaatgcggtcactgcttgaatgcttttgtttgcggacaggggtaggaagacagtgtgcaaggtctgttgaaggatgatgcaaagatggctggccaggtccaactgtgacaagctggaaggaatctggggttcatgtgttaggttgtatatgcatgcagctggaattttgttttttttttgagagaggtgttcactctgtcacccaggctgtactgccgtggcacaatctcatctcactgcaacctcaccctcccaggttcaagcgattcttgtgcttcagcctcccaagtatatgggactacaggcacgcaccaccaaacctggctaattttggtatttttagtagagatggggtttcgccatgttggctaggctgttctcgaactcctgacctcaagtgatccacttgcctcgtcctcccaaagtgctgggattagaggtgtaagccattgcacccagctggagctggatttttttttttttttttttttttttttttttttttgagacggagtttctctcttgttgcccaggctagagtgcaatggtgcaatctcggctcacggcaacctccgcctcccaggttcaagcaattctcctgcctcagcctcccgagtagctgggattacaggcatgcaccaccatgcccagctaattttgtatttttagtagagacggggtttctccatgttgaggctggtcttggactcctgacctcaggtgatccgcctgcctcggcctcacaaagtgatgggattacagatgtgagccaccgtgcccgggccacagctggatattttgaaccaaggaagtaaaagaaaaatcttcacattctaaaaagcaatctctgtcaagggagtgcagtgaagggggacaaagagaaagcccagttaggtagttactatattagtttaaatgtgagatgataaagtctatgtgcggatataacatagaattataattatgatcgttggaagagaaaggaagagatgagttagacgcatactggagaaacattccaccagttttagggagtattcattttacttaaggaaaaatggggtaagagtcagtgtcaagtttctagcctcttagttccttcgtgaatgatggtaggtcagcaggcagggatgatgtcactaatataaaagacacaagaagagacagagaaaggtcaagatttgtgtttctctcatatgaaaatgacagctggaatcatgcagatggatgagatgacccagcaaagaatttacagtgagaagagtatgggaaacaggggttttgcaatgttccaagtatgttttccacacagtaacatttttgcatattcctattaaataactaaaagggataagaacaattatattattttgcattgtagattttaaacatagagaaaaatatgtgtgaatatttgccttgtgaggaggggcatatgagaaagtaatgcaactttgagaggggagatgaagtaaaataaacacaagatataaaccccaagggaaattatttaaataggaaatataaaattattcaaattgtaaattatctaggaaaaacacccaataattctaatggtagcttaggatattgagccaattttttaaaaattattacaaaagaaagatactattcttaactcttgcttcaagccatgcaatcagacaaaaagggtaccatttcaagctctttcatttagcgtatctatattcagatctccattcatatagttcctggcatgaagcatctgaaagaagattaaaattaatgtaggagtgcaacattaagacaaacatcactgattaacttgaactgaaccaagctcaaagcaaaagccataacagggaatcagtcagaattgaaaagaacaaatagaagacttgtttagtttttactgtattccccaagaatttgaaaaatttagggtccaatttatattattaggaaaacaaaaagttgtttttcatgttctattggcttatgattgctctggccttttaaataggcctacattccaatataaatattgtcatgttcctaagattagtatagataccttacatgtatatggtacctcccaaatttgaagtgtcatgagtattaaatgatttaatgcatgtatggcactcaaaagtagatttgtcatatagtaaatactttaaaaatttactattaccactactgctgccactactgctactactagattgtatgagattaacagtaaaatcaaaactatattctgcattatttattataattagttgccctgaaatattttaaggccatcaaaatcttagttggttaaatgacctactggataatgtatctaccatacacacaaacagatacgtatgtgcttatgtgcacacacattctccaacataatttgtggaaagagtagcaacaaattaaagaagagatcatgattttcaatcacctaaataaatctaaatccatatgcaagagaaacctagaaatatggtataatgtaactgatagtataaaagctcagccctaagatttcttaatagatccattggccctatagtctacagctttaactatgagaactcctgacaagaacacccaaggcagatccagtgttcaatctttcttttgtacaggcctgggtcaggctctttagagaaataagaacgcaacagcaccaaggctgggtatgaaaagaatattctctccacgggcctgtcttcgacagtgagcttatgctatagctctcataacaattactcatcaccaacaatagcatcccagttctgcagtgacagtgtggttgaatagatttcactcctggcactcccatgataccataatggcaaatccctatgaaaacatatgataagactatcacttgggggtggtttttgctcaatagctattttattcccttggagtattttatctttcttcataattatatcaaagggtacatttctaataactggtaatcccttccttaagtgactttaacctccgtaggcattgggccccatgacccatagcacaaacatattttgtaattaaattttttttcaatttcagaagccattgaggaaatgttctgctttatataattgttctccattaacagacatttaatatgaaagttttcataatttaaacccatttaatctcatccttatatgcttcatatctcattttatttttgctgttttcaacaatcaaaacccttattattatagataagagagtatatggcagatcttttttctttctcttttcctttctcttttccttttcttcctctttgttttttaacgaaggctaatagttcttaactttagaagactaacaaggatgcaagagtgatacaatttttcaggagcctgaagtaccagtcattttaagtagcttcagattacaacctgtgtgggaaatagcatgatcattttcaattacttcatcatgaaggagaaccattaattagttttaactggaaattgctaacaacatttctacaaagtttataggtgtaataattcaattttccaaacataatgaagaaagtccacaaaatgttgactatgaggaccaaatcaacctctttttgcctagaataaacctgcacagactttatcaacatataatcagcagaatcaagcctggaatagatcaaaccagaaatgtgatccagtcatcctgttccaattaaagaatggaccatgtgttgaactaagcaaataagtgtagataaaataatctatgttgggatttgagtacaacttttctggctgtacttcaattgtagctaagatccaagttgaaaagttctggcaatactgcccccatacccaccatatattttaaaggaagctatcaatgacctggaccagaggcctgtgaccatcaccttgcttttttcaggcgatggtcacaggcacctccttgcacggtttctaacagaagacagaactgacctattaccaataaccacaaccctagcaaaacccaaatccaaaccccatttatatacaaaactgagaaaaggaaaagtcacagatctttggaaagtacagggttctttctctctgggaaaaatcattgtatggtttggcggtgcctgtcaaaaagggaaagtattagcaggtttctcttcttgctgtgtcagaacggaccagcgtgagagagtttttgacagagtatgacatgtgtttttggatttggtatccacttttctcccagagcactgtataaagaagcctcagtgaggtgcatggaaagaggacagaggcattcacaccaaaccaccttcattgcactcttcagaggatgaagaagcagccctgggagacttctcgcagcttcaggagaagattcatgatgaacggaggccaagcaaataggaaatccaaccagcgaccagatcaggtaggcagcataatggctgggactgaatatggatgatgacccttctctggggtgttcatgagcaatgctggaggaaagaagaagccaaatgcaaccccaagaatacctactctcgctttgccctctgtggtggattgataatgaccataaatttaattctgagttggctatatgacttgcttttgacaatggggcattagtaaatgtgtcacaagtagatacttggcaagtcactagcactggggctgcttgtgagccccacgactgccgctgtgtgacaaacacttctggagaacaattgcctctgttgctagagccaatagcatgccacatcccagacacattctgcattacccagccatcagctaccctgccacatgaccacagacccaagagagagacagtataaatcacttgagctggcccagactagaataactgcccagctgaaccacagaatatgaagaatcgttagaatggctgctgggttaaacttgttataaccaaaagttgagcaaaacactagtgacctgctttacaaagtatattatggcaccctatagattacaactaaactcggatcccaaatcaacttaaaaatgctatgatacagtttttgttaaactgtgcctttatagaaatattagtgaaagaaaaaaaggaaaacacagagtagaaaccctctacggaagcagaaaatagtcaatgtggagttgctctgacctcaagcagcttgaaagagctcaaacagtgggcctgagtcccctggcgtggcgtgaaaacaaggagcaatttggtttgctttcatgtatcttctgataagttgaagtagtggaatgcattaattccactctaaaataattaaatcaatcctttatttatcagtcgtttactggacacttaccctatgcaatcaactacactatctaccaggagatagtaataataaatacgaaagctatagaaaagaaatgagagaggggaactggagtatacctttatgacaggtacatgactcagcattctaaaatgtatgctctcatcgcttctcagccttttggctaagatcaagcgtctaaaatgtatgttctctttttctaaccataaagccctataagaaccttcttcttatgctcagagaacctatataaccctattttaataagctatgaccttgttgtttgcctgtaaattctatcctaacttaaggagatggagcacctacagtatggtacaaaaaagaaggcggccagtctcttacgaaattcagagagaaaaagaccacagattagccgggcgcggtggctcacgcctgtaatcctagcactttgggaggctgaggtgggcagatcacgaggtcaggagttcgagactagcctggccaacatggtgaaaccctctctctactaaagatacaaaaaattagccgggcgtggtattgcacgcctgtaatcccagctacttggaaggctgaggcagtagaatcacttgaacccaggaggcgaaggttgcagtgagccaagatcatgccattgcattccagcctaaacgacagggcaagactctgtctcaaacaaaacaaaacaaaacaaaacccacagattatagttggggaaggaaggatttaaaaaataaataaaagctttgttaacaaggaggattctgagttatgaggaagagaaataaatctgatattgctagaaatagaaaaaaatgattattctcatgttttgatatcacagaaattgattttaatatagaaatattttaaatatgggaaagtaaaaagtagggaaaaagtccttgttttcctctaaatgagctataaataaatatcctttgggtcaaggaacttaaacttggagtgtagcatgtgctgggaacacagagaggtatatgatcaccccataaaaagaagaaaagtggtttgactgacacagaggccatactaagtccaattgtgacacattaataggctaagaaatggactttgagtgccaggctattgaagcaaatttagatggctaggtataaacagaaatacaattttataatggttctgctaaaaaacagaaagctaatcctgggataagaattcattcactgtccaacacgtttgtttattttgacctgttggtccaagcactgtagagctgtcagagaaatatatgaagcagcacacagaagcctgcaaaccccacaaaacactaacatatttgtgtttttatacgctttctatcatttttacgggctttggtgttggaagagtaaggtgatccaggatcagagtccatcaagttgaaacttaagtctctttgtacttatgagtatatatgacttagctattgaaaatccaattatgtatatatacactatatatataaaaaattgttcctccagatacttgcttctaatttgctaaatgttactatatcaagagaataacatttcttctattataatttactaacttcccagaataagtcagatgcctcctcaaatatttaagactcaaaggggccaggtgtggtggctcatgcctgtaatcacaccaatttgggaggatcacttgagcctaggagtttgagaccagcctgggcaacatggcaagaccctgtctgtataaaaagacttttaaaaattagccaagcatgacagtgtgttcctgtggtcccagctactcaggagactgaggtgggaggatcctgcgagcacaggaggacaaagctgcagtaagctgtgactgcgccactgcactccagcctgggcaacagagaaaaaaccaaaaagactaaaagggagtaaaagcaaacaaactcttacttggtaatcaaccacatgttagctttgggaagctgagagttaatgcagaaggtttttatatgagtccatgtgtatttccccatgggtaatttgatgttaaacactaaatccaagtttctcagaggaacacagtctttaaatggcagcagtatcatcagccttgctgccttctggctttctatcatcttcctttggacatctctccaaaatgggatctggtttttattttagacacaacttagaatgcagtttcctatagtcaggcagggacaatgaggatgtcaatgaaatctgaagtaacaggaaggatgctttgtctacatctagaaagagagtctacacgtgtaggggaagcactggagcacagattgcagatggactgaaagtgggcaacaaataagaagactgataaacattccactggaccacgggtcaaggtccatcttggactttatattgcacccttggggaagcatgggagtacagaaatgggtcagagcagatgcagatctgtgaagacatcttcatttctctgatgtggaacaaggacagatggatgtaaaaaatgtgtcttggcggatctggaaagagcatgctaccctttgggaaaacatctgggctgttacattgttttacagcacagaaggcaagaatttcaagctctctcgccctgcttaagacttctgtcattcttacactactctgtcactgagaaagctaaaaatttattcaaaggtctcttcaatgaaatgcagattaaaggcattttgtgcatataagtctggtctcttaggcagcatttaactttactatgtccagagcatatgtcataactaatttgggtcatgtttgattactcactatgggtcaaagttgaaattctgttgcaaaacaccagagtaaacttaaccatgaatgtttttctaacagtctgtgactaaatgtgtaatatacactaacaacaacaaaaatctgtggccaatcatggactttctaatgcttggaaatggctgaaagtatatagaggatattcaaggccaccaaaatatactgtgctaaaagcacttaattagcaaaggctaactatacatctgcatgtacacatacttgtgtattttatatttctttatatatctgttagaataaatatgcatttaattaatataaccacacatttctttcctatccaaggagtccacttgcatatatacaagggtttgctatattataagaggtcactttcactatgcacttagttacatatgcttattctgtcttagaatgtacaaatttatcattttgacaggtaaaaaaagtgtaagaatccaagcagaaaatatttgaagttacagcatctggattggtaaggaggctaaaagagatagcataggtgacagaatcgaacccatgtctttcattgatggtacaaggtgagtaacctaatgaattagaaagacaagccaataaaaggtcccgagttgacctttatagtccttatatgcacatacatctttaaattctcccattatataaattaatacaatattggcaatattggttgtttcatatcagcacaatttgtagctgaaattgattattaggaagtggtttgtggtatacagtaaaggaggaccagtgagaggaaggagtgcccattcagagagcagggccacagtggaagggaggcagacagagtgatgcagtttgcttctgttagccgaggtacaggggaacctactccttgatgaagatgaaccactctggcgccatgaatacattgaagattactcagtggtcttgacaacggtcattactaatgagagcgaacttcctgaaatcaacagcttgcctaagactagcacagtgtctgatatgcagcaagaactcaatacatgtcatgctctgttattggaagcaaaatgatacctattctagtccattccaattttgaaacttattttagaaacaaaactctttatttttcatttgtaaatacatatatatatatatatatatatttgggccgggcgcggtggctcatccccgtaatcccagcactttcggaggccaatgtgggcggatcacctgaggtcaggagttcgagactagcctgaccaacatggcgaaaccatgtctctattaaaaatacaaaaattagccaggcatggtggtgggcacctgtaatcccaactactggggaggctgaggcaggggaatcgcttgaacatgggaagcggaggttgcagtgagccgagatcacgctactgcattccagcctgggtgacagagcgagactgtctctcaataaaaaaaaaaaaaaaaaaaaaagaaaaacaaaatacacacacacacacacacacacacacacatatatacacacacacatatgcatatatgtgtatatatataaatttataaatttgtaggtatacatatcaagaaacaaggaaataaacatagaagtaaagatcattttctacttacttaagtttactctaatttttttgtctcctttaagccaccactataaatttagagaacgctttattaactgtgaagcctgaaaaaaaattatgtaactaattaatctattatttctgctacaataagtgagcctttgattcttttcccgatatagaaataatgatgtgtgtcagacaatttttaaaaatgagaggtacagagagacggacaaagcaggccttgcctccctacctaggtttgactgttttaaactttaaatgaatactcaaggatttcctccaggatcattaattagctatttccttatgcaaacggagacaactaaagatgttttattttcttcctctatatcttctctcctttatgtttttcattcagccttgccaggaagaataaacatgagctgagtcacctgtactatttcctaatagtgattcatcaccaagaagcagtaacagactctccctcctttcttccctctcaggatgtggtaccaacaaggcaagtctcacagagccatgccacgtgccacatcctaaccttggattccccatatagcacctcccagagagctgaaatagcctggacatctttcaggcctgctctgatggagagagctcagaaacagccttttcacatgtgtcagattttcatctctctgaaacgtattaacagtttacatggcaggccagatgaagcctagaacccagacagtcaacgggcttgggctattgtacaaaccgttatctaataaaaaatgtctattattttaggtcagttgtcatcactatccatttagtttatggtgagtgttcatattaatgttaccaaaatagggtgaacatcctttatgacaccttatcttacgtgtaatcatgacttgacttacatgcaatggcgaactgaaataaaatggtaattgccacaaaatggtgcttggcattctaaaaaaattaaaatttacttcaaaattcctttagaggtaatatatattcatcagaacttatcaattaattgagtaaatacaaaaacactcaaaataataatattcacaagaagtacaactgcgtttaaaatctgaatgcctggcctacatttacatagtctaatagctaactgaagttttacttgtttctatctcttttatgccaaattgtttttattctgactgagatgacataatattttaattttcccagaaaagaaaaaattaatgcagaaaaaatcaacaaaaattcagttagaagaaataagttctagcattcaatagtacagtagaaaaattatacttagcagtaattcgttgtttatttcaaaagcgctagaggaaatgaactataatggtcccaacacaaagagaaatgtttgcagtgataaatatcccagttatcctaattttattgtacattatatacagatatcgaaatatcacatatacctctcaaatatgaactatatcaatttaaaaattcaaatgttcatattgtatcatgtgcaatcaaattttacttaatgcaattcactatcactttgaaacctgctcttgggctaggtttatgcttatttcatctgaatagagaaaccagaagttatcatccttaaataccatcctttgtggatgttcccatcatgaggacaaagtaataaatttcagttctcaaggatgagaagcccaacagattcactccttttctgcacacagaaccatgctggcaacagtcccaatgcctaagcttcagtcacaactttcagaaaggtgctatcaagtggggctgcaaaagaatccctctatcacctttcaaactgacacctgtgttgattgcttgagcccatcacagtttagctctcacagctttaatttactagcccatgagaagtcagcttcaaagaacaccatttcgactctcaaagaacattatcaatgtacatggatagcttccaacttcataaggtgtttctctctacctagagcaattaacattaatttgcagaatagtgtttattgaaaacctttgtgtatctccaacaaagtaatagtgtattgatttcattcctactatcttcaactgtatcattaagaggaatttcttaggaaagtctatatgcagtaagcaagtaagatcgcagaacatcaagggagaagtaaatccaaaactgattttacttcttttcttagtgaggaaagaattatgttttaagcttgcctctattcatataaccttaaaagtaatcattctgctttttgtgggtttattataatttgaacaatgtttataatctctcaattcaaaaaatcataatctgtacatgttgatcaaccaagttataaaaatgagatgaatttttaaactccatgcaaatctttaagagataacatgatctatctgtccataaccaagtttaaaactttgttgataacaaggccaaatgcaaaatggggggagtggaagaaaacaatacaggtaatttagacagaggcaagtcaaatgatcagtaccaacttaaaaaaaaatacatacacacacacacacacacacacacacacacacatatatacactgtttcattgtcaaggctctttcatattaagagtaatcaacatataattaaatttaaaaaaatgtatgtatagatgagtatccagctatataaccctgcagaggagctgaacaaagtcattcaatgaattgcagatgacatagcaatggaaagaatgaattacctttgtagttatcttcccacacccaaccattaaacaaacaggaccctttaaagactttaaggtaaacagtggtttctcaaagtgatgcaatgatcatgctgtgcctgtataaggagcataaaatgttcttcacaacagggttatccagtgtttagaaggaaatctctactggcaaatggatctgtctttttgaggttacagtttataggctggattcaaacgacaaattcctcaggactctttagcctaagtgtaaataaagatgcagaaaggcattcctttaaaaaaaaaaaaaacactccgtagacatggtgatgacagtgaaaggaggcagtcaaatgcctagtcagatggggcaggatccccttttaaactccacctccaaactgaagacagtttaaagcctgaaagccaagctaaaaattaaatccttggaccagactgagaacctgtcttcccatttgttgcactttgttctgattgatccccacccttcatgtattttacttatccctaccctttcctaattggttttctacactgtcctgcccacctttgagtggtgtcttcgctttaatcttttttgaatattcacataccaatcagcacatactcctcattctgagtccataaaaagccccagacccagccacactgagaaaaaaaccacccgactgaaggggtgaggaatcctcccaccccaccgctgcccctgactgtgagctgttccattgttcaataaaattcttctctgcccatcctcacccttcaactgtcagcctaccctcatttttcttggacgcaggataagagctcaggaacccccaaatgtgagtacaaactataacacaggtgggctagggtgcacccagctcagccatgggccaagccggtgtacaagcgagactcagcgggctgactgcctccagcagcaggcccagggctgagcaaggtgggggtgagggggggtggagagtggagggcacatcaccagctggaaccctgcaaattgtcagaaaattcctgcgtcagtgattcagtgatatataaattcaaatttcaagaattcattatttttataaagtctttaggaaaggatccttggattttttttttttttccattcaggagcagtgttggcaccattgtaaagggtaagggtaacggttgagatgtccaaatatacatatatatttatatatatttagtgatctaaatgtttccagtgccaaagttagatgctttgcaaaactataactcctttaaatgccatccatcttgaaaaaatgcatgtcacatcactagaatgttacttatagtcctactagagtttaaaaagatgtttcctaaagacctaccatttaaccacaaactgggaataacctaatatcaattggaaatgctgttaaacggaaacaaatgtaactgatacatttgaagcaagaggagattgaagatgaaggtatatatccaaaatggtgacagtgacagattctgattttcccattttgattaacagaatttcctataggcatcaataagctataaggtggataagatagttctgttgtaaaagtactgaggactcattatctggactctcaattctcattattcagtttacttagtttcataaaactttaagctaaatctatattctataaagtacatatgacaatattaattatattgtcacctttctaagattaaaaaattaagtattttttgaaaacttctcagttcctggcttggtttttccttctcataataatttatttatttatttattttattttattttatttttttgagacaaggtctcattttgtcatgcaggctggtgtgcagtggtgcaatctcagctccctgcaacctcgaactcccaggttcaagtgatcttcccacctcagccttccaagtaggtgggactacagacatgtgctgccacgcctggctaatttttacattttttgtagatacggggtttcaccatgttgcccaggctggtttcaaactcctgagctcaagtgatccacccgcctcggcctcctaaagtgccaggattacaggcctgagccactgtgcctggccaataatatgttttgaggagaaaattttaatgcaatgtaggttatcattaagattcatgtttttggtgttgtagctgaaaaacatttcctaatccaatctgcaaagattttctttttttttttttttgcagaggttttatggtattatgatttacatttagatctgtgagttaatttttgtatttggtgcaaggaatgagtcaaacttagtgttttttgcatatgggcacccactttttccagcaccaattgttgaaaaggcagatgagtagataaataaactgatatatccatgtaatggaataccatttggcaataaataataataaactactgatatgttgaacaacatgagtgaatatagaaataataagcctgagtgtcagcttggcacaagagtatacacattgtaggatcccatttatataaaagtctacaataaaaattaatatatagtgacagggtgatgactgtttgcctgggaagcgtattggtgaggctacagtacagacagccaagatggaggaattacaagtgtggtgaagtttcgcaggtctatgcatatgtcaaaactatcagactgtatgttttagatatgtgcagttgatcacatatcaattgtatctcaataagtatctatacatatatacacacatatgcatatacagatggtctcctacttacaaagttttgatgtagactttttttttttttttttttgagacagagtcttgcactgtcacccaggctggagtgcagtggcgcaatcttggtacactgcaacctctgctcatgggttcaagcaattctcctgcctcagcctcctgagtagttgggactatagacatctgccgccacacctggctaatttttgtatttttagtagagatggggtttcaccatgttggccaggctggtcttgaactcctgaccttgtgttccacccgccttggcctccctctgtcacccaggctggaacgcagtggcacaatctcagctcattgcaacctccaccctccaggttcaagtgattcttgtgcctcagcctccagagtagctgggactacaggcatgtgccatcacactcagttctaagtttttgtatttttagtagagaccaggtttcaccatgtcagacaggccagtcttgaactcctgacctcaagtgaatctgcctgacttggcctcccaaagtgctgggattgcaggcgtgaggcattgcaaccggcctcggcatacaattttcaaactttagacggtgcgaaagcaatacatattgagtagaaactacactttgaattatgaattttgatgtcccaggctagagatatgtggtacgatactctctggtgatgctggacagcagatccaagctgtaactgccagtcagccacatgatctggaggataagcaaccaatacactatatgtactgtgtttcctgattattttttctaactgttagctaatgtaagtattctaagcatgtttaaaattgggtaggctaagctatgatgttcagtgggtttgacatattaaacgcatttttgatttacaatattttaaattatgatgggtttatcaagatgtaacctcatcaaaaatcatgatgcatctgtatacatacacacatactatcaggcgtgtttcaacaatctttttaaaataaaagttgatattcaggccgggcacggtagctcacacatataatctcagcactttgagaagctggaggcgggcggatcacttgaggagtttgagtttgagaccagccaggccaacatggtgaaaccctatctctactaaaaatacaaaaaattagccagatgtggtagtgcgtgcctgtaatcccgctactcaggggctgaggcaggagaattgtttgaacttaggaggcggaagttgtagtgagccaagatcgtgccactgtactccagcctgggcgacagaatgaagactctgtctcaaaaaaattaaaagttgacattcacaatcaagtcatgttacattgatcttgattggacaagaatctccggaaatttttatttatccaaatgcatatgtaggtatggtgggttggtgtgcattcacttattggagggaagagtctaagaaagttttttttaaagggcctaaataatctaagcaaaataaatattaatccatgctagccacattgtaagtgttaaaatggaaagaaatcatgagattctcaaaatgtagccactggttggataaaaatcctcagcaaaatttgtctctagaaatacaaaagctccttcattgaaaaatgccctcaaatgaaagtaattatgaagctactcacaaaattagaagtaaaaactcaatgacggggagagacgaacatgtggccatgtaatctgctccctgctcgtggagtttcaagctaaccgcagtggttttgagtataagaaatcatggtcacaggaacagggaggaagtgtggaaaggggtgggctggaggaccggggagtttacactgccagatatgacaactcttcgcacaatgaagtttgaaatgtaatcaactgctattttaaatttgacctttttttccctagaatagtaatttcctatagactgctttcatgtgagaaccatatttggttgcttaagaaataaactattaattcactacccacagaaaggataacattcatttgttatcaaatactaaatgctgcacattgcattagactcgaatttgaaatgtaattcctatgcatgagtagtgtttcaggaaacatttgcctcccatgttttctccccttgacacttcacgttttagatctttgttgctaccatacagaaataggtgcatttggtttttaaatactggaaataccatacttgacataaaaattatatgaaaaagagcacatctaaaatggacatcaagaggaaggaaaaaagaaaaaatacaacaaaagattcagtttcttccattaattataaatttaaactgctaaagatcctaaaatatttcacctttctggctaattgttctgcatagtttatgagacgcttatcaaaaagaactggggtaagttattcatcaaagttttatcattaatagcattaatagcaaaagcataccttttggaaccatggaatattacagaaatagaaagttgcagttcaaatgctgtttgtatatagagagaaaacaagaagacaaattttatgagatttcaggtacctcaggactggttttgaagtattatagatcaaatatgtgaaggttataaaccagggctcccaggtaagctggtatagaacaaaatcaccagtggaacagaaactgaaaatacttccgctgaaaagatatatactgaatgcaaaatatgtgtgtgtgtgtgtgtgtgtgtgtgtgtgtgtgtgtgtgtatagcaagtttcatttatagaccaatgcattctctttggcaggggtagttttttaagctactgttagaaacatatgaagaggggtgtatgtaggagaactgcttgctctagggttaggtgtatttctacttcaagaagaaagccacccaaagaattgctgtttcgaaatctgtacgaatagctgagcctctcttgttttcttcactcatgttcctaagtaacagacagcagactaggatacttgggagttacatcccttatttggctgtttgaactataagactaacagcatatcaaaagctgatcattaaaccctcctattttgataatatcctcagtatgaaacagcttagtgaaagacagaggttggccctaacagcaatgttcattatagccataacttcacctctgagtagggcaagagttgaaggaacagatctgagtagatcaccagtagctctcactaactgaagcttcttgagggcaggattatccaattcatatttgatcctcagcgcctagcaatgagactgaaatacgttagacactcatgattatttgccaaataagaatggagtcaaattcatatccattgtgaattacccagaaactatacattttaagataaaaagtgattgtaaacatagttccagcccattcctcttaaaaattctagacaaggtatattgatggtcaaatgttgcagttctcaaaaagtctccagcctggacactgccttgggtagatctggtcatcagtcctggttgctgctccaagtaaaaacttcattcttgatttggggttttcttatcacctgaaatacccttttgcaaggtatgtttcttacatctctcctcacataaactccgtaaaaccacccctctcgaatgctaccttctccaacgaatctctcctatttatcttatttgtaagtaatttctccctttcctaaatgacacaatattttatcagtacgttataaacaatgtttcacattgatgcaatgaataactaccagaaatgcaaaaaacacaaacaatgcagatgggttccatgatgaatttggcggtacctgccttttccaggcttcaaggctgctcttatttttcattcactctattgcttctgcctcaaatatcacaacctgcctgtaatcctgttccctcctctcagacaaatgttctttaaggcatagctcaggagtcactttctccaaaataatcttccctgacctcttctccaatttcagatgagtaaggtgttgttaacgtgtcctactcacctgcttccatagtaccatgggcacatgtccttcttcactaaggataccacattgcagtgatctgggaaagcacgtcttctcactgacctgagttctttgaggaatggaatggcacagtcatcatggtatttccagcattttgctaggcctcagtgccacagtggctgctcaatattttatgaataaatgaattcagttatatttgcgtgtaatctcctattctagactgtgtgctctttgagctcagtaaattcagtatttttggtacacagtagatatttttaaatgcctcaatgaatgaatgaatcatacaacctttaggctggaagtaattatagatatttttagtcttatttctctctcttacaaataacatatgatgaccaagctaggttctatacatttattcatggaatcaggatcaaggcataggtcttcagattccaagccacacaatttattcttgtatactgtgacatttttgaattaattaattctatatgaagactaaaatattaaagtcatcactatgaatatatatttagaaatgagaccttattttcacggaaatttaacaaaactggctgtcaaccatttttaatggattctcctagtatgtatcagaggctgacagttacaggcaatccattataatagaaagagaaacatgttatattctaaatactgcaaattaatcattaataataatttaaaaatccaatagattttggtttagtcagcaaaatgttttaaatacaagtgttctatacattgcagagatgctaagttacatttaataccatttatcaaaaccttagggagttattctttgggtctccaaatctcaaagacattaaaccaggaccaagaatttcatgaatactgtggcagattcctccctccctccctctctactaacagtgatttcaaggcaatgtgacagcaacttacacattacctgtcaatagcaatgacttagccatcatctccctggaacctttcattcctattactcctaaatcacctataaagaaattggtaattaagctgctagagacatctgggctaaatggattttgagccaagaagttttgaaaggctgattattaaccttcggtaaaacacaattaagagaacacaccagactcattctcagcttcagtaggagagaaaggtcagggctatatgtgtctggtagatttaattttctatatcactattagacagcctagattatttttaatctggttacaacaacaaattctactgatttttgaatcaaaagtcaaataaaaacctccagtataaacctgagttttctgcaagtattttctttcagaggcataacagtctccattttctacagaattcataaatatgaatattttagaaaatgtctataagtgttggtcttctaagttctcggtgctgcctaaagtaaatatggtaatactcagttgcccacctatgagcttttgtgtgtcattagcacaaatctaatgcttcatatgcagcaatacaaacactaacatcatttcttttatatagaaatatgcttcccaagtttaagttcaaaaacacatctgactttaaacaaaatcatgtttgttgtcaatgttttattctctctcccaaaaaccttccttcctacctccagaggcttcctctcccaaactaacacatctttcttcagcctagggagttcattttaacccacgtaggtgaaactctctttagataccctctaacaaggagggtacaactcctcccaccccaagaaccgctatctcttccagccttaaaacttccagaggaaaaggttatgctagtggttacagaaagcaagaccaatattttgcagaaggaagcccattctatccaatgttacccaaatcatatcaggcaggcaatcatcctccaaactgcttgaaattatgaatgcagaaattaatgttaaaatgaaaatgcctatagtcctctgctacagacaggcagagaggggaagaactttactaacctctacctcagaagaactctttctctttgaggaggaacatcttccataaaaactggagaaaaaattgggccttccaattatcacacatctccgttcccctcaacaattggtgtgtctacagtcccctccatctggtagtgatttattttcaaaggatgaaaattaaaaagaatcacaccttgcaatttggcttatcgattccttttcatttatctaaactgagcagtcatataacatccttaagaaaagagactttaaaacttccactgcttaaaaacatccctaaaagaaaggacttaagaatcacctctatcaaagaaagtttgtttattattttaaggaagatataaattggaaaaaaccatactaattagaaacttgtaaaacttccatttgaattataaattcatgatgaaaactaatacaacacaatatttggatattttgttatacataatgaaagtttcagatttgggaaactgaaaaatacagagcagatatcaacaacatttgggtacataatgcggtgaactgttagaaaaaccacagtttccgtaatgaagttgtagtggaagtacaatcaccatcgcataagtagatatcagccaccatactatgcatcctcttacaacagcaagaatgactgttcctatagcagagatcgagtccattagaatttcaaccactgaaaaatgggttgagaccacataatttgctagtatatgtgacttcattatattaaatagggagatttttatatgtaaattgagattattaacagtaatggtcataataaatacactcctcataatttattgcacttcagtaacatactatttgccacaatacaaatactttcaaaatcctaacaagatgtgctcaaaactaaattgcaaaacaaataagccaccacctactgttaaaggttagtttaagtatttcaaaagcaacaatttaataaagattaaggaatttaataagcttcccttttcctttaacaaaaaagctttcaagagtcaatgagcaacaacaagaaagggaaaacactagcacattaaaatgtggtgtgtaaagtatggtaataaatacacttaagagaggtaggttttaataataacaaatacatttttttttacaccaatgactgcccgttaggcacattcttaagtcaacttgcatggttgtggctatttgtcaaaacttacttcatcatttacagtctcagagttcttttccttttagctcaatgttgtgatggaatcaatacagatctgctcttaaaatatctgtctctgacctgtgtttgttttaagctgtatcattcataatggtgatggattggtaatgctattcctctttgtctgcacaaagcaccatggcataaaaagcacatatattttatgcccaaggtcaggagaaaattaatggataaagagctagataaaatggagttcaagctgaatgggctgagagcgctctacaaggtacagaccaggcaggcagtacaaagtccattatacttaaacactcttgaagcatttcagaagtgaaattgtttccacaggctaacacataaaagcaccaagctctcacatggcttccactgagtgcccacaggtatgggcaaagtactcctgctcacgagcttccacggcatattccatttatcaatttttaccttgagcaataagcccatttggtgtttatcaccagagttgaacaagttatgctttgttgtcattagcaaacttctcttttaacactttcctactaattctatttctattgttcactctcttactgtgccttgtgaatacttaagagtttagggtctcccttaagaggcagggccagctgattccaacaaaaacaaagcttcatagctaacaattacacgctattttccataacatgcactctcagacatctaaatggcagcaaactaagtagaaatttaaaataataacaaaaacaaagaccagtaactgagaattctaaagtttggcatgcagaacaccatcaaaatcatccatgacaatttggctgataatatctatgcataaacataaggaaataagcattttgcctagttaagcagtccaaaaatcaatggttttcttcacaaaccttgctgagaaaagcaatattactattttgttgaatataaaacaactgagcaaagccatattagaatttatcctaaatacctcactttcagatttagaaaaacaatatttaataaatagatagtgtaagtgggttcttccatttgttcattttaaggggaatgcatagtaacagttgtgatttgtccttatagttgagccttcaaccctgtgacactataaataaactgctcctggagctgcggaaattgcccattatctccaagagcatgttctgataagagtccatcaacatgaagccaaaactcattcagagcatcaagagaggaaagtttctagtgatggtttggtcatggtctctttcaggatgattgcatggcagaggaaggaataaaactgtgaaagaattaaagttggtggatgcggaagtaatgtgtacagtgatgatatagatattaaagccaaaatgtggcaactctgtttgacaccgcaaagcaaaatgcattttttcacgtaatttagaaatatattcaggtagcactcaaagagctcatttaatattaaatataataggcaagttctgagtgtcagttaaactggactgaatgtttgagtttgtcataaattaggtgtggctcacccaaaagcataatctttccattttagtttctttatttgtaaaattaagagtcagaatatagcctccaaggactcttctacctaactaaaaagcaaaaccaaacccttccaaatatcttccatgatattctcttaacataaaaagtcccaggtttatgatccaaagatagagatcttggcattttaacatgagtgcagtgacaagactttctgacctgagtccacagggcagttacacacataaaatgacttcagggaaactcttcacttagggaaaaaagcaattatgaggaatttgtaagtattataaaactatttttaaaatagtaatagaaagctgaaatgaagagtaatggtctaaagctaaaaaaaggaagaaattaacattagacaacacaaaaattcttcaaggggaattaggcactagaataactgcttagagaggtacttgagtcaacctcattggaggcattcagaaatagattatatcaaaacctagcaggaagtctagtgttactccttaacttgaaaaaaataaaaaacaacgtagcacatttccactacctaacttaccatattttgcatattattttccatatatttcatattactgtgtatacttggtgctctgattatattggtttgcatgattctattttcacatatatcctaaatatttccaaagtttcaacacactgttattataagcttaacatttcaaaagctggttaaatattcaacgttgttgatatattttaacttcttattctggtaaagtacatttagattataatttattgccatcatagcaactcctatgctacatatttttgttcatgatctgttggtttctatcaaattgaatcctcaatttaaactcctatgactagaaataccaaatcaaatgagtatttcacacctctggctatgtattgctacttctaaagccctaggtatgaatgaatgcatgacaactcagtgctgccattttaacatgtgctgataatacgttccaaaaattctaaaaaatgatgtgcaaattttgttattctcttacataactaaagaaaggtattggtgctactaaagatatacatatttatttccagtatgtatttaatatatttattcctgaaatgaaaagataggcaaagtagttttaaaataatctataatagaacactgctttaacagaatgaagacagacttaaatttcttgagtgttaggaaattggggagaccctggatcatctcaaacaatactgaagatactcttcacaagtcagttcactctgggtcaatggcaatcagccagataaatcttgttaatattaaaactggcttaaagccagacagaattcatttttttctcaattaaaatagatggagccatctttcttgactattaagcatatctctaatgttcacaagcctgcctttgtttcatttcctctccctataacataaaaatgataaaaaatattctctttatccaaaaaagttgcataatttttatcacattagaaaaaaagcatcagtaggagtatttatggaacattactcttaattctgcatttttacctatgcagaacattttgtaaccagtgttcaatattatgattaaaacataaatgaggttaatatttacaatttgtttatatttcaattagaacaattttagaattcatgtgtgcataagcttggcagaaaataatttctctaatgcatattttaacttcatttagggctgactatggtaatactaattattcatccttgtattttcagatagttggaagaaatggcagttccagggactttctggttcctcctcagtacaaaaccatttatatcatattctattattgctccatctcaactcctgtgcaaacctattaatacctacagatactgcacggaacatgctatgccattcacaatttagtctttcagattgaaacatgtcttaattcatctcaagaaaagactagaagaaaatggtagttgcttcttaaaattaccaaaatcatgatcatcactattaacaactgataatacgccataatgaacactctttggcactgtctatcaataaatattattttaatttaaactattcattttggacatcatctactattgtagttattataatattgtcctctgataaaaacatctgaacattttaattcatgatgatgatagttgggaggccctaaaaattggtccaacactttaaaataatgtataataaattaaacaccaaaaggcattaagcaataaaatgtccattaaagcactgtatctcagcagctggaaaacacctaggtggtatatatagcaaaatataagtatcaaatatttggtggtacatatagcaaaataaaggctaaccactaagaagaaaaatatttttcttgcactttccacatactttgttattacttttaaagttcaaggcatagtttcctgtgggttcttttcatttttcttcattcagtaaaataaatatccatcttcagccagacattcattcctccccctgagctattaaaactcaattaattgcttagttaattgccaatcccatttaaacaactcactgctgaactccaaacaaacttataaaatgaagtgatatgctgagattcataagcagtcacaaatgtaaaaataaatttaaaaaggaagaatatgcatgcccaagaagaaatggcttcattaattaaaaaatcaatatcatataaataaagacaaataaaagcaaattaattcaaccttggcaataaaggcacaagataatttggtcatctatttcattaacgcgtttgcaaatagatcacacttcatcagagggtttacagaactgtcctcgtactctacgaatagctgttcaagtagttcaggctgcaaacaagtacaagacttctgaccttctacttaaacagaagtttttaaagttggtgattatatatcatttaccaagagtaagctaaattgttcctgaaattaactcaaatcacttgtgttcatgagaaaaggaaaaaggcgattatatatttatatatttcaagcagggtctgagtgaattgagtatccagtaccaacacactcaagtattctttttagtccctaaccgcttacttcaaattttcatagaaaaagcagcaatttaattctaagagtatatcaaatgcattaaatagccctgtacggagtggccaatgtactaattcatatgtgctggtgaactctttgcctgttgctgtcttaattcttgaaaataaattacaggctagtaagtatccttcgttactgtgacctccctcaccctatggattttaccagacgataatctagaccagtgtctctgcaaaaacgtggctgcagaagagatatattcgtttatttggtaagcaacaatgaagtacttaagtccataaattttccattacaatgtcagaaaaacaagaaggctcactttttgctcaagaataattcagaaaggaaaaaagcaactgctcagtttttcaaaatgagtttaagttgcaaaaacaaatgggaaattgtgcaacaaatgtagtgactctaagtcataaatgcattaacttaaatttattaactacagtacctaccatgtgctaaacactgcacagggtaccaaagatgcaaagactagctagggatgcttcctcagagggctgaactccataatcgactctgctatacaggagatgtactacaaagatttcagcagagaaataacttaggtcagtttacatttacaaatgagatagtcctaacagcctttaaatccccacatgttgtaatggatgatacttagtatgcatgaaagcttgggagcaaataatgtttgcacaaactgtttatctatccttataacaccaaaccttgaagtgttggaagattattgaaggcttttttttccttttaaatattaatgtgcacacttttcaaccaattgttggcatagaatacctgcagcaattcttgattctatcatatttataaaaaataatgtcaatacctataataactataaacacataatactaagttttgttttatggccattttgaacttcctgaaataattctgcatttaaggcagacttccaaatacaatgaaagactcttactgatatttgtggggagaaataatggttcttttatggtcatgatttgcatttttacagattatctattatactttatgtcttttccaatgtttcctaaagcttcacattttggttgtattgtaaaaccaaagtaaacaaaatttctacaggttaaggtcataataattagagttatgtgtagttctctttttgtgtgcatatatacacccacatacatgtatatagatatttaatcttgtctttgatctacagcaaggctaatgcagcaaaaaaaaaaaaaaaaaaatccatatttgcatatccgtgtctctttcctaagtatctctagttgcatgtttcctgaaaagagcaaaattcaacagagccaaagtaaattattccctaccaccaaaccttcacagatatgttccctgcaatcctaatctcagtgtatgccacctataccaaaccaatgccaacccagaaagcatctttggtgactctcttccttagtggcaatattcaactgctattgatgctaccttttgagttactgtgtatctcttcttgccaatcccactgtcagcagagccatctggacctttatcacctgttgtctattttaacttcagtactaaaaccctccaatccattctccttccacaatgcagctagagccaagcttcaaaacagcaaatatattactaaggttttcctgattcaagtctttttgcttcaaagactacccaaactctccagcttccttttttccactctccccaccatgacctgtactccagaatctgagctaaattagagttctgtgaatacacatcacttgagcatatgccattcttgctgcctgaaagaacttgaactcttttattttttatttgtttgtttgtttgtttatttatttatttattttgagatggagtttcgctcttgttgcccaggctggagtacaattggcgtgatcttggctcactgcaacctccgcctcctgggttcaagcaattctcctgcctcagcctcccgagtagctgggattataggcatgtgccaccacacccagaaaaaattgtatttttagtacagacagggtttctccatgttggtcaggctggtctggaactcccgacctcaggtgatccgcctgccttggcctcccaaagtgctgggattatagacgtgagccactgtgcccagcctacctttaactcttgttaaggatctctctcaccaagagatccttcaagacttcaatcaaatcctacctccttttgaaagcctcccctgacttctctaacatactgagcattgcctgtctctattctggaaacgactttaatacatctttgttattctacttatactcaactgcagtagctataaatgatggttccagagcagcagcctctgcatcacctgggaactcattaaaaatgcaaaatctcgggccctactcaagacccgctgaatcagaaactctagggatgtgggactcagaaatttgtagttcaacaagcctttcaggtgattctgatgcgtactgatgtttaaggaccccttttctattgaaatcctgtgtgtccatcagtctctacacataattgagaaggactttgatggttttcatcttcctttcattcttctgaatatgcaatacacatttgttgaatacagagcaaataaactggtaattaaaattagaattttacagttaatttcattgcgctttatacagatacagattcttagcatgctatcggtctgtacataggatacacacttgaaatgtgaagatgatcatgtcaagacgatagcagatatgatgcattgccaatagttttcttatgataatattcaccatgaaaaatgaataagatcatatgaagttattttcatgttagacaatagggaaacttaaaagatgctactaagagtcaagggccatttacaactttttaagtaatcaactaggtatactgttgatcgaacagagcccccaccctccaacccctatatatagtctatttattaaacagagtttaatgtttgcccttcataaaacatttcgtatataactgatattaaaagctgtaatactattatttgattcataatttaattcggtgtttgcaaacacgtgaaacaaaaactcagaaaaattctctaggctgtcaatacaacaaaatgctctacctatatgttaagagagtgcagaggcttggttatcagccagctatgacatagatggggctgagaagtggaaaggcaacaggatccgcccacactagcttcaagtatttagacacatatatctaaatggcaaagtgtttgaaatcaggactgggcttaacatgttgtactttattccccatcctcaagtgtcaattacaggatgtctgcatataatagttatttaacatattgacttaaacagaatttccatgtaattcttctttgcttaccattttgattaaaaagtacaggagttaaacttcaaattacatgaaattagtaatttaagttatttaaaagtcaattcatctcaggcattgtattctgttcctactattgtgtactacttctgtcactgatctcaatttataaatgtattaagctggatttataaatatttcagaggtgctctaggacagagatgatatatttttacctctgtatatgcaacacttacaagtccaaatctgtagtcgattttaaaacttaataataatttgattaataaatcatagcaaagaaacagggagaataaggatattgctatagcatggtatcatctaaaatcagttgatagaaacaacacaacattttctttgtaaatgtgaaagcactgcttaaagttccaaccaactgtccatctaatcttttccatagcttattcttcataatacaaaagcttcttttctcttggatctaatgctaatgctctcctggtatataatcctcagtaagaaataattttaaaagaaaagatataataaaagtactatccatgaagttttaaaactggaactttgctaaatatattatccttattagttttaaataccttgggtcaaaatatgcccaagaaaaactggtgactgttcattcattccacgttcatttgttcacactgacatttattgatcacctgctcatgccaagcattttaataagtcctgggcaataaaagtataaaaaacccacagtgcctgtcataaaagaagtcacattctaggggaacaaaagatacatatatagttgcaaaccaaagtattttaatggaataagagacatttacataaaggtattatcaaatcaaagtagggtattgaccagatctgggaaaggcttcatagagtaaggttgcagtggatgggaaagatttatcaggtgttgtaaacagagaccaggaaattaagctgaaggagtatcatgcagacgtaccttggaaggaatgtagtatgttagatggaaacggaaccaaaagtgttcatgatgggaagaaaagctggtgaggcaagtggaagcctggtgaccaggctaaacagttccctctttttgccacaggcaaaagtgaatcatcagaggtgtgaaacaggatagtggcatgatcagatttcactcctgggtggtagctatgaacattcatcagggtttgcagggattacaagtttccagtcattccacaaattattgaccaaaaaaattatattaaagggaaaatatatttctattaataacaaatgtgtcatgataatgtcaggtattaagacagaatatacgaaacaaatgtttatggaaagtgttatcagtagcagtagacatgtgaaaaaagactagtttgcctttggaaagataaaggaacaaggtaatatgcaaagaaagcaataagcattagagggagataactgacaaaccaagacagatccgaaatgatacatgactctaaaacattgaagcagtaataagaaaatagtttagaacaaacagcctaatcacctgaagtaatagacctaaaaagtggagtgacgatagcaattaagtttctcttgtagaatatagacccaaggtatgagaattttctttctttggttttaaatatatgctatatatgctgccgtctgcagaccctgatggactttttatttttgaaagtgaatacagcacctgaatgtaaagataccaaagtacgtgatagtctgaactatcagggaagtctttgacaggttaattaaaaagacttaaacttgaggtgttgtattccttatgacaccatttttagcactaagtagtgagtgatgagtgagaaaattgtgtaattattggaatagctaattggtggtaggaccatttgtaagtacaacaaaataggtattatggtcagccagacaaaagcagctatttgtatgtactcacgcacacatacacacacacacgcttatataaacagcaaatagcaaatgtggatacaatttttcgcaatgatagaaatactgttttgcagtgatcctgtggaagtaggaagccaaacagtagatcacatatcactgacatcctatttcccaataggtttgctgaaaaatgaaaagcagatttgttgttggtaattgcaaatgccctaattttcaataatgtaaaaattagaacttgtatatattcatatttatcgtgacaaacacactctgcagaaaagaatgttgtttagttcaattaattggtttggtactgggaatggccctaagaataaactccagggtgagttctacctggaagctggaacagagagtcaagttaaagtaactgtaagtaagatgctgtagatgccttaggaatatattataaaaaaaaaatcaaaccaaaaattaaagagttaatatttccagtcattaaaatggaaaaagagactcagtaattctaaagaaagcagaaattagcaataggtaaaaatagaaattggtgaaatacaaaaacaaagaaaagggaggactgacagaactaaattctcattgtttgaacacagtaattaaaatcctaaacttccagtgagtctgatcacaaaaaagagggaaaagggacacataaacatcataaagaaagaaaagggtggccggggccgggcgcagtggctcacgcctgtaatcccagcactttgggaggccgaggtgggcggatcacgaggtcaggatattgagaccattctggctaacacagtgaaaccccatctctactaaaaatacaaaaaattagctgggcatggtggcagatgcctgtagtcccagctacttgggaggctgaggcaggagaatggcgtgaacccagaggcaaagcttgcagtgagccgagatcccgctactgcactctagcccggacgacagagcgagactccatctctaaataaataaataaaagaaagggaagggaagggaaggggaggggaggagaggtgaggggagggaagggcccggtggctcacgcctgtaatcccagcatttggggaggtggaggcgagttcctgtcactgcactccagcctggatgacagagcatgactcaatctccaaaaaaaaaaaaaaaaaaaaaaaaaaaaagagggaaaaaaaggaggacagagctatagataatttacaaatttttaaatactaaaagaataaaagtttatgtctataaatttcaaaaatgagagggcactgataactttctagaaaatataaactattggaagtgacaaagatttgaaaatggtaatgacaaatcagaaaaaagctcggacataagtagggaaatctgctatgagacagaggcagtatttcacatcaggagagaaaggttgggactagccaataaacagtgttgggacaactatgcatccatgtagaataacaagattagatcgccactttacaacaaacagaaaaatccatttcagatgagttaaagacgtaaatgtgaaaaagtaaatctgttagatatatttattaccttgagtcagaatattttttgaacatgacacaaaaaagcaataatcataaaggaaatctaatactgtatatttgactacactaaaattaggcttttgttcagtcaaaaaacaaacatcataatgaggtagataggctagtcccagactgtgaaactatttttttcaatgcatttaactgacaaggaattagtaaacaaatgtgcataccttattgagaacaatgatataatagggaaaaaaggaaattaactggcaatttatagaagatgaaacatatggagaataaggataagaaagatgttcagccctactaggcaccagtggggggaaaaacaaatttaacaataagatactattttataacccttcagattgtccaaatgtaagcctctgaaaatacaaatattggcaaggatatgtagaagaggtaaatcttagttatgctggtagaaatataaactgggacaatcactggagacaaatggtgatatgtggcaaagttggtgggctttgttttgttttttgctatttaattcagcaattggatgttaaggcaaatttctggagaatttctatcttaggtaaataaagaggtatgtatgagttggagcactgcttgaaattggaaataattaaaaaccactcagaagctcattaacttaaaaatggattaataaattgggggttattgattcaatggaatatttaagacagtggtccccaaccgttttggccaagatgaaactgttccacctcagatcataaggcattagattctcataaagagtgcaccacctagatccctcacatacacagtttacgataggttttgcactcctatgagaatctaacgcctccactgatctgacaggaggcagagctcaggccataatgatctcttgtccgctgctcacctcctgctgtgcagcccagttcttaacaggccagagaccagtaatgatctgtggcccagggttggggacccctgatttagacaacatgtttcaacacggattatttgtttttagagacagcatgttagcatgttgccatgttgccaggctggacttgaactcctgggctcaagaaactctcctgcttcagcctcctgagtagctaggacaacaggcacaagccaccacgcatggctggataatttatttaaaaaaaaagaaacataatcttgaacaaaagaaaaaatcatgttgaagaatgataccagttatgtagattatgataccaatttatgtaaagtttgaaaacatgaaaacctatgccataaactatttaacatatatgcacatgtaggtgtaaaacctttcatggagataatatatacctaaattacgttgcttttgtcatctgttatgggaggtgggaggatggaaatggggaagaagatagagtagacttcaactgcaatgtttcatgtccttattctgaagtatgcatgacagaagagtagaatttaacagatgtttgttcattgttgtttttctgtactttcttcatttcatatctaaaaagcaaagttcagctgggtgcagtggctcatgcctgtaatctcagcattttgggaagccaaggcgggcagatcacttgagcttaggcgtttgagatcagcctgggcaacatcacaaaaccccatctctacaaaaaatatacaaattagccatcggtgtggtggtgtgtacttgtagtctctgctacttgggaagctgacacaggaggatcacctgagcctggtagttcgaggctgtagtgagccatgattgtgccactgcattccagcctgcacaacagagtgagatcctgtctcaaaatttttaaaaaattttaaaaagtaaaataaaaataaataagaagcaaagtttactagtacctccatagcaaatatattttccatacccaatcataaaaagcatttaaccatttctgcagtcatcaatgagaaaagaaatccctatctataaatacgatgtcttttctggtcacatcttgcaaccaaaccccagaccattaggttgggtagaaaaatgcacagatgctagcctcccttagattgccaatatgtgtgtgtagtacatattggtattggtactaactgattagttactgaaaaaaaaaaaaatttacattcttctctattatgtttttacttattatgccattccctcaaaatgtggcattctggtattcagcaaaaatactattggttttgattaatgccaagaggaaatctatcattcatgcactcatgctttcatacacatttaattatgtattatttttccaatgttctagagactctggttaagaaatctaccccagcatttcctaataagttgggtgtaaatataacaaacagcagaaaataatccagtactgtattagtccattctcatgctgcaaatggagacatacctgagaatgggtaatttataaaggaaagaggtttaactgactaacagttcagaatggctggggaggccccaggaaacttacaatcacgttggaagcggaagcaaacatgtccttcttcgcatggcagtgtcgaggagaagaatgagcaaagggcgggaaaagtcccttataaaaccatcagatctcatgagacctcattcactatcatgagaacagcacggaggtaatctcctctatgattcaattatctcccactggttccctctcataacacgtggggattaggggaactacaattcaagatgagatttggaaggggacacagccaaaccactgttaaagtactttaaagtactttaaggctcaaatgaatacaatgcttgccacgtgaaattttcaacgtagatcttcaaatatgaaatatgaaattcagttagtcaactctactaaattttttttaactgcagagttacaaagggagaaaaaggggaagagtagacagatgcttgaagatagatggaaacaaatttattatatatttaactttataaaaagaacaggaaattgtgaggctctgcagtctcctgggtcagtttcctgatgccctggttctgtcaaggtttaatcactaaactacaccaactatagtcactactttgtttttaagccactttgagattttcgctatggactggaaagtctgggatatgaatgcctaagcatgaagaaaggctggacaccataaaaatgtgtaagaattggtgggatttaatttcatttgggtcacattaatggccatgaacatgacaactctgtaccataccaaccaccatacattgcaaagtagtcctaactctatatgtaggtaagtcagatttcttagtatcctttacttgctcagatgaaatgtatttatttatatattctggtaaaactatatgaatgtctgccatgtgtgaaagttatttttctgagtgaaatttacaattgcattgaaaaaatgcttgcattttgccaggcacttctgatttctctgcctgtactatttcattacaccttttaaaagctctatgaggtagactatgttcttatgttagagatcaaaacattgttatggagtcagtcatctcataaatccacttgtcctctctctgccatgattgtgccatcagtcaaagattaaaattttattataaccaattaaactcataaacaatttgtggatttaacaataggcattacttttaaaaaataatttataggccaggagcagtggctcacacctgtaatcccaggactttgggtaactgaggtgggcagataacaaggtcaggagatagagaccagcctggccaacatggtgaaaccccatctctattaaaaatacaaaaattagctaggcgtggcggcgtgtgcctgtaatcccagctacttcggaggttgaggcaggagaattgctagaacccgggaggtggaagttgcggtgagctgagattgcaccaatgcactccagcctggtgacagagctagattctgtctcaaaaaataataataatttataatatcttgtgtattataaatagactctataaccagcattgattcttctgtattaagtcttcaccagctcatatttcttcccttcttcaccatagcagtgtcagcctctaccactcattccacattggaatctttcattgttctttgtgttgtccttatttcatccacttctgctaggctgggatcaaaggcaattatcaaaaaaagggaacctaacaggctgacttggttaaatcattccattttaaatattcaaaagttgaggcccccacaacacagtatgacttttcatatgggtaaatcaagatgagaatccatacctctagctctgcctcactacaacaagctgcctaccctcctacccccagtcactgtctatgcctttggttttctattgctacccacacatttgccaacggcattgctagaccaagtatgttcttaaatattttatattaatactagattttaaaatataaagtggtaaataataaagtcagcgaggttatcttgctctaactcctcacttaataaagaaactgaagccggctgggcgccgtggctcaggcctgtaatcccagcactttgggagactgaggtgggcggaccatgaggtcggaagattgagaccatcctgactaacacggtgaaacccagtctctactaaaaatacaaaaaattatgcgggcatggtggtggcgggtgcctgtagtcccagctactcgggaggctgaggcaggagaatggtgtgagtccaggaggcagagcttgcagtgagccgagatcacaccactgcactccagcctgggcgacagagcgagactccatctaaaaaaacaaacaaacgaacacaaaaagaacggaagcctagaaatattaagagaccagggttacactttttatttttatttattcaactacttacaaataataaaaatctgcagaggcactagtgacatgttatgacaactggtttgatcattatttagattttggatttatttagattttatattttaataattttgttcacctctgtaacagtacaaaaatcagcagcttttacagtaatgcaaggtttcttctaatttcactgaccttttcctaatacttcaaaagaaaagaataaatacatattggcttctgccaccgttgtagttaaacaaacttgtagaattcgaaaatatttaatcaaaatgttttgagtaaaatgagtaaaatataaccttctatataatattccttaaagtttcctaatcacataaaatggaaagctgaatttggaaaaaaatcaaattaagttcaacagactaaaagttctcttatatcccaaaaggaaaataaagatatgcttaggtatgaaatatctgacctcaacggccttggaaagctgtacatggtccttacagccaagtaacaaagaaatttgaaacatgtgttacaagaaaggaaagaggaaaacacttagtaggaaaggacaaaacttaaagatccataaatataaatcccgactgtggcaaataattttctgaatgtctgtttccactgaccagatgaaaatcgtaaatcctcaaagatgccaacaagtacttgaaataatcaagtcacgagaattaaggagtaaataatagctctgtgcatctcaggctaagaagccaagagccttcaacaatctaccagccaatgggcaattctcctcagaacacatgcagctcccccgtgacaattttaggtaaacctgatctttgcctatatggtgtaattggttttaatttaaggattttgttttactctgtgacttctacccatgagagcgaaagccagcaaagctaggctaatctgcattctgaaatttcattctgtgtttttattttcctttggagggttcttgttacagaagagcttcattaacttaattaggcatgatccagtgggcccatacaaattaggctagccacagtatctttagaatggacaaaaataagaagccagctgtagtctttatattttgaagaaaatcttaccagctgacatttctttgtgtcacagtcatattaagcttatgacaactgcaataaccaaaatgtgttttggaagttcaagtctccaacactatgaaatataaaagacacaacagtggatagggaatgaactgttttttttaaaccacaattctttttgtaggcatctagctctttgctttattatagaaagaataatcctttggtaaaagtgtgcttataaatcaatttataactactagcaatgtgataactgtatcagaaaacatttaggagaaaagatattttcattttcttcctagaactcacaggcatgtgtacacctgtgcatacacgtaccaagataatataatacaagataatacatgtatcagataatgcaaagaaaaccagacactacttgacctgcaatcttaggaagttattgattttgcctcaatttcttcatcaaccagcagaaataagaataaccctcattcttcttcagagaaatctttaggcaacttccctgtttcaaaaggataatctggataattgttaaaatagagattcttggaccatatttcagacatcctgaatcaggctttccaccgaagagccaaggaatttgtatttaataaaagttattcttagtgggtcactataaactaaaatataaataatgtgaaatccctatagattcttactgggttattataaactaaaaataaataggaaagctctatagaaaattttgagtgatatataagtatataccatcaacattattcagaatttctagcgcaaaggaaaatgttgcaaagaaagtattcttacaggaatttattctggctaacctttacactatgaagagttgctgtgctgatcaaatcaatcaacccaccaaccaaacaagcatcttcaggaagctcaacatatacccttctgcttctcagataagtacaaattttaaccgataaacactaaaagtcacatctcatacaataacatttaatgtagcaaaatactctagatatggttctcgtaagtcctggaattctggaactaaatcataaacaattaagcataatcacagcgactttctgacttgtcgcttgattctttataaatgtattctcaagaaatacaataagaaaacatggaagaaaaaatatgaaaaccttccaacctaattctaattatctgaattaaccatgttgaaaacaagatactacttggagtaggaattcactgtcaccataagctatttgtgacttaaaaactagaacatggagttcagaacacaatccaatttctgtagatgacagtgagttcccagcaggggttgttcctctccagaaacctgtcttggatagtatcctggtacttggttgcgttggcacgtctgccacctcagaaatcaacaaagtcatgcttccgtttgaatgagaaacttgacacattcctctgattcctgaactgtgcctacacaacctgttataatgttttgtagattgcagtgaatactgctgaagtctcacagtggctacgttcaatttcaaacgtatatttgcaaatttggaaaatgtaaattaggaaattttctggaagaaaattatgctggaaataacagaaattgcttgcgttcacttggtcaactaataatgactgaacctcggtaacaaagatttctggggttatgaacgtcggtttttgcaatgttcacgaggttccaaggattatgacctaggccatacttaagggtacatagatattatatctatacaatctgtatagatatagtacagtcataatatgagctggaattgattttattaaagctgataatagaaaccagatggtccaagtatctgaatcaaatatagacttccttaagctagggttgaaaatagctcaagaaaaaatgaatgaagttctaaatatgacataagagctctgcggaggtaatataagtgtggatatccaagaataataatgacttgttctgaactaagttaattacgtcttccaaggtattttatttggagaacgctgcatggttgtgtgctatatcctaaaattcaagtgtgcagaagacttatcagagggtgggtagaaagttgcaaccaatcaagttttacatgccttagtctctttcacttatgggtgataggattatcaagtttcctgtccttctcttcctagagattatatttttacatttgaagcctgtagctactttcccatcttgcaacccaaaaaccaaaaagacactgtgttcactaactggcactaggtatgaacagaatggatgttttcaaacaaatgaatgactcaaaggaattcttaaaatgtttctttggtgtgaagagcaggggtcacaaaggcatatggatagtaaatatagaaatactagggatttgcatgcaagtttaaccagctacaaaccaaacagaatagttctgtctaaaattaaggtaggtaattagtttcctactgctgttataattagctgtcacaaactcgatggcttaaaacaaaaacatttattatttttcagttctggaggtcagaagtcccatatgagtttcactgggttagactgaggtgtcagcaggactgatgttagcagtcctttatggaggctataggggagaatcttccttcttgcattttccagtttctagaggctgcccacattccttggcttgtgatcctttttcatcttcagagccagcaaaggccagctgagtctttctcattttgcataattctgacactgactcctctgcctccaatttaaagacccttattattacattaggctcacctggataacccagaataatctccctcacttaaggacaaatgaatagtaacatcaactgcatctgcaaccttaatttccctttgccttgtagggtaacatagtcatcacaaggttccaaagaataggaactagtcgtgatttggagtgggatggtcagggccattatttggtctacccacaaccaagaataatgaaaatcatattttgctcctgcctgtgaatggtgaaaacttcaaaggaagacacatctgacactcttctgttgggagagtttattcaacttcattttgacttcactgacttctatacactgatccaaggtgtttttttattggcaggttggatttaattttcaaaagataaactgcttgattgcaatcaaaatcaaacagaataatttatgaaaaatggaagcaagaggagaaagaatgtaggaggaggtggacattttccaagtgatttaattgaatattatcttaagaatttctgaagctcaaattcagaaggacacgtctagttggctaaattaccaagtctgagagtaatgaaagagttgccattccatgagcctagagagcaaaccaaactagaaatagcaatctcacttatatatcacagaatttcagtttaagcataggatacaagactaaatcaagctttaaatgtgaactctgtattcactatgtaaaccttctaacggaatagccttcagtgtaaagagctagttggccataaataagtttaattcccttcctttaaatttagatttgactcaagctgcatgaatttctggacagagaaaaaataaatttggggcagctagctgttggttttacagaattaattccagtccagccttgtaatcgcatatatttattaaaataactttgaaataaaatgtacggggtcaaaaagtatcaaaatatggtgactttaacatggaaatttaaattttaaaagaactatgtggaaaaattaaaaataagacatattgacaatacacttaatcagacagatttgtcttgatactaaaccctttcagctaaactcaatgccctccttctagctcttcttaaagtttcactcttcaaacaactactcagactcaaagtacacccccaaattcaacccactcacacaaacctgacttgatcatgtaaaatatcctttccgctttagctgactaaactttaaaaccaatctaagcacctggtgtgtcagtgataatgaacaatagtgcatatggcctatagggagttagagttgactcctaagtgagtaactgcttgccactgacatacaaggacttgaatagctctgggaacgtgcacagctctttacttgcagagtagaaattccaaggattctacatctttcattttgattacagtcgacaccaaaggcattcacacttgagatactgactgtcctgattctacagttctttaaagtgtctcaccaaaataataagcaggcttcctgatgtcttttctttattcacatgacaaaggttgaatatcgtggttactgagtggcagatattgagataattggtgtctcgaagcacataagggttgctgtgcttgaagattttcactaaattagtgcttaaaagataacaaataattgtaatataacatgctgcgtgttaatgcagctattacataatatagactcaacgagaagataactaactttactgaacgaagtcaaagacaggtggtagcacctaagttgaatcgtgaaggataggtagaggtttgacagaaagaatcaagaaggacaatataaacaaatatgaaagcaatttccaacagacataaataagggcagtacatttgggaagctcaggatgtttttatgtggctggtatgaaaggaagaaataggggaacagcaaaagacaaggctggaaaggatggctgaggagaaactaggaagagcttacttactgtcactgatgaggacttctttggaaagtcatattctcagaagtgttaggaaatcataaaagaaacaaaattttcaactgaaagcatttgattgaaaaaagaccttgcttgagggcgtttatctttatctttgtgaggtcaaattttgctaaggatggttaagatggtaaagtcagcacctgatacagaagatgcttgactacaaattcataatatatctatggtctccctggaccattcagttttaatgcctacagaaccagtgtggaacaaaaggtacgtagacctggtgaaaggtcacacttgtttattgtaagcttgcctttgttgttgctatttctaatttcaagtaagaaacaagtttccagacctcaaataaggagatataactggtagatataactagtagatcttctcaaaatgacattaacttctttttgtaaactcctacttcctcatagtatagctggagaaacatcttaccaatgtggagtagacagtgatatcttaatagcagaaatgtctcacaatttgattctttattggtgtgaaacactgtatcataaaaggtttcgaggccatatccttaagaggagtggtagattttcaatgaaagagctgtttagtattttggaaaatgcaacttctaaaaccagcaaacaagtatcacaaatggtgatgatgatcatagcacccttggcaaatggcctccagagaaccatcatagctggtgaaatggatacaacatgattaaagagaacttccatcttttctttctgagcatttcattataccactgattctcaaagagctggccctgggaacctagtgaggtctttcccagtaggatacatatatatgcatatctcatatattcacatatagtagttatgcatatactactgatatgagtgatagggacttctctagatcccaagttaacttcctaatagtagaaaaggcactacattgatgtaatatataatgcccagtaatttccactaattctagtgtttgctttttttgctggattggtttgacatgtgaaatcacacagaataaatctaatctccaatctccactttacaatccccactccatgacactcaattactttaaatgttttatcctctactccaaagtctgctgttttttaaagacaaaaatcaaaccaaataaacataaatcctaattatctcacttttctataatagaaaacttacaaagaaatttcaaacaaatggaaaagtttactttatcaaagatctcctaagaatctgtaatcattctctaatattaaaatgtttggcacaaacatcagaactcaaatatataatataaatcctggcaaacaactccacaatatattgaaaaatccacctaatcatttgatacggtttggctgtgtccccatccaaatctcatcttgaattgtaatccccacatgtcgagggagggacctggtgggaggtgattggatcatgggggcagtttcccccatgctattctcatgatagtgagtcctcacaagatcatggttttatatgtgtttgactgttcctccttccgacgctctcgctctgtcttgcctgcggccatgtaaaacgtgcctgcttccctttctgccatgattctaagtttcctgggacctccccagccatgaagaactgtgagttgattaagcctcttttcttataaattacccagtcttgagtatttctttatagcagtatgagaatgaaatcatatatgtttaaccccttttttttttttttttttttgggacagagtctcactctgtcacccaggctggagtgcagtggcgcaaacttggctcactgtaagctccgcctcccaggttcactccattctcctgcctcagactcctgagtagctggaactacaggcccccaccatcatgcccagctaatttttttgtatttttagtagagacgtggtttctccgtgttagccaaaatggtctagatctcctgacctcatgatctgcccgcctcggcctcccaaagtgctgggattacaggtgtgagccaccacacccagcccctaaacctgttttttttttttttttatggcaaattaaataaaaaactttaagtcaaaatgtgtgaaaagattgcagacaaccaaactatggcagaagagtttgatcacatgataagcttactctgaaaaatagttttttaaaaaacaagaaggatcagccaggtgttgacatacaaaaccatatagccaatcaaagcttatttgaaccatatacctatgttgagagagacagtttagaatttaaatgccatacaggggcattcagtgcttagagggaaaaaaattagtactgcttttatctggatataagccatgagtggagaaaaacaatgtacacacatgtagactttatatatgtatgtatagtcacataatctttcatatatatgtaatataacaaaccaatgtctgggaaagttaatggcaacagtttaagagcatcaagataaactctttgtgcttagaaagtttagttttgtcttaatgctattcatgaagtgcatcgaaaagttagtttaattcaataaacactcttctttagaattatttactaagtttactgtattggaggtcataataatgaatcagaaggtgctcttgttttcactgagcttatagcctaattaataagaaaaagtaatgatgcgtaatccatgtgtgttgacttttaaaaattcctgctctatgtgtctctctttaaaggtgtaagttagtatgtcttcagtaggctagacacttatcttagttacccacaacagatgcaattctatgttgtgcctatgccattgtatatcgctacaaatcataggttaagttcctggaaggaaataacaggctgatcaaggattttcttaaaagcttcaatatgtcttaaaggcacaggtatcagagattctaaacatatttatctttttcacaaaagtaatatatcctatttgataaaactatagaattcatagtaatgcagggtaatgtgaggttcaccaatcattgtaagatataaaatacaagaaaaaataatatagtattttgcatatcatgaattatcttaatatgaaaataatactccatcacataaaatatatggattttatggattatatggattatatggatatatggattatatggataaatatacgcatttataatacagtctcaaaaataaattagcaagtggacaaatacaataattacttttaaagcactctggggaagatctgaaaaaaataaaaaagatgcttaatatactacattatttaaacaaatgtaaattacattgagttcatggttctatttatgaacttagaataagcatcgttaacacataaagaaaaaaacagacgacaagaggcctgcagaggagcagaaacaatgcggaaagtgagaaagaaaagtccagttattttgaaaaacaagactggtttcaatattatcatttggccatcttaaggaactgcaggttaatcaatacattataattgattaaaaggaagtatttacaatatatacaatagtactaatatatttagacacataaactacatttaataaaatctgtgttaagagtcctaaacaatgctataatatttaatccttatctaagctaggcaacacaaagcaacaatattgttgataaacagctttgctacataaggtattgggaaactaagtaaacttgtgatagctttggtttttaaggtgctatggttggactccatttgacacatttaataaatggtgcatacaatttttagctaaatatctaacaggatgtcatcctaaaacctcatgttcctatattactgtgctgttaacagaaacagcttgcagagatttatggcttctattaattacactaaaaaatatggtagatttgctcaaataaatcaattgtaacagaaaaaaagcgcatttttaaaattacaatcatgcgttacaaatgactgccattatcaattctgccttttcatttattcccaaagtgaagggttaaagggggaatctttctgttttcctagatttaaccctggaagagcagtctttgagttagtactttaaatagcttacagggattctagttaatagcctcaaaaattggaaagaaatgagacaaaatatcaagacaagaataagattgaaatatataaatttctgcctatccctgtttttataaagtaagtttcctccccttaccaattatgtttcagttctatatttccattcagtgctactttggctttttttaaaattattcatatacctgttaatacaccctccttgttccacaaagaatttaccaatctttgcatttatacaaacaataaaagcaaaaatatcaaaataaaacaaaaaaaaggagaaaatatttttacaacagtgaaaataaaaggaagaaggaaagatcaaataaaaaacagaatgcattcaagtttacatttagaactacatttcagatttctgaacactttttgttgggctctaaatcaatatcaatttcatgctcactgatgttcccaaggagttgtgtttctttattcaatatggccctgaacactgtgagccctagatgtaacttatattctcaaatacttatgtggcttggcattcatacagaatctgtctgaattggtaaaaatactcagatttgttttttcactcttcattaacctcctatgacaagtataatccactatcccaaatatttattattatttaaaagaaaaatgtactcatttttcttggaccaacttgtttaaagacacaaaggactcatcatcctgaagaaaattacaaatgtattaataactttttatgccatctataaacatctctcattttggtactaaagaagataggggtctttttatccccttactagttagagaagagccaaacatataaatatgcatggagaaaagcctgagagaacatctaccaacatgtttacagtatttatctgagtcactggatcatgattagactttcatacattctccaaattttctacaatgagattattgttcaaaaatagccagtgcactctgggaggccgaggagggcagatcacctgaggtcaggagtttgagaccagcctggccaacatggtgaaaccctgtctctattaaaaatatgaaaattagcccagtatggtggcatgctcctttggtcccaggtatcccagttactcgggaggctgaggcaggagaattgcttaaacccaggaggcagaggctgcagtgagccgagatcatgccactgcactccagcctaggcaacagaacaagactgtctcaaaaaaataaaataaataaataaataaataaacaaataaacccagcatctgaaaagtatcaaagtactgaaacaataaaggacatataatcagtcaatatgaaagcataatatttttgacccttagaaaacaggctaggaaaatggtctttctatcagatcatgccttttaacacaagcaattatttccaaaaaccaatcaaatgtacaatgctgcttatacttcatagcactaaaaagtatccttcatcatgaatgggagaggatctttcattggaagagccatttgtaaaggaaaccactgtctgaccttctcagagaaatgctgtcttccaacgagttaaaatgcttgggttatcaatctatgagccaagttggaatcattaatcccaagtctagacatttcaagacgtagaagcaaaatagcaaaagatacagagtgtatagagttctgctcctttgctggaaaaggagacaaaggttgaactttaactgaaaaatgatacggtttgtctgtgtccccatccaaatctcaccttgaattgtagctcccataattataacgtgtcctgggaaggacccggtgggagataactgaatcaagtgggcaggtctttcccaagctgttctcatgagacttaatacgtctcatgagatgtgatggttttatgaaggggagttctcctgcatacattctcttgcattccaccatgtaaaacatgactttacttctcatttgccttctaccatgattgtgagacctacccaaccatgtggaactgtgagtcagttaaacctctttcctttataaattactcagtctcaggtatgtctttattagcagcgtgggaacagactaaaacaaaaagtaaaaactgtctatggccatatctgtctatatcaccctgaatgcaccccatctcttctgaaaagtaaaaacaaaacaaaagtcattgaagcatcagttacctatggaacatcttgtgtttgcaaaactgatgcaaacaataactctggagtaatgaatttttttgatacttttttttcttaattcaaaagtagaaagttacaaaacacaaaattcacagaaaacaaaagggggaacgcaagatggatgagggctctactgatggccctttcccccacccgcccaccctttttttttttttttttttttttttttgaaacggagtttcactcttgttgcccaggctggagtgcaacggcgcgatcactgcaacctccgcctcctgggttgaagcgattctcctgcttcagcctccttgagtagctgggattacaggcgtgcgccaccacgcctggataattttgtacttttagtagagacggggcttctccatgttggtcaggctggtctcaaattccctacctcagatgatccaccagcctcggccccccaaattgctggaatttacaggcatgagccacggcgcctggccggcccctcccctttggtagaaaccaaaaatcaagtgagcactcgcagtgcctaattttgatttcatattgttgaaagaggcactgaagaaggtagaaaagacagtggtgaattgcccacgctgcccctcccccatcccctggctgcagcctggtagtgtaaggaatctatgtgcttgggatgggtggagcacagtgaatgggaggctttcatccaactcagtgctgccctctcacagtggaaagcagaaccaggctgtattcagccgacacctgcccatggagggggcatttggactggcctagccagacggaggggattgcccatcccagcagtcagagcttgagttcccacaagcctcaccatcacaggctgaagcactctgaggccgtatgtgaactccaggggcagtctaggccacaaatactgaaattcctaggcaagtcctagtgctgcactgggctcacggccagtggactggaggggcatgtaacctactaacactccagcctgggtagttaagggagtgcttggatcacccctccatcaacaccaggcagcaaagctcacagctctaaaagacaccctttccttctgcttgagaatagaagaggaaagagtaaagaggactctgtcttgcatcttggatgcccacacagccacagtaggatggggcactggtcaggtcatgaggtccccattataggccccaggtccctgatatttctagacacatctttggccagaagggaacctgctgccttgtagcaaaggacccagtccaggcagaatccagaccctactgactaaagagcccttagtccctaaagaaccagcagtaatacccaggtaatataccacaggccttgggtaagtctcaaacacatgctggtttcaggtgagaaccatcatattaccaactgtggtggctatggggagaaactgcttctgcttgagaaaagcagagggaaaaataaaaaagaaactttgtcttgcacctgaggtaccagctcagccatagtggggtaaagcaccaggcaggctctccgggtccccagcatcctggatggcatttctagacctgccctgggccaaagagctgatcgccttgaagggtgagtcccagtcctggcagccacaagctgactgaagagcttttaggccttaagtgaacactggcaggagcttggcagtactccctatgggcccgtggtggtggccatggtgtgatgttcctctatctgtggaaaggggaccgaagagtgagaagcactatgtcatatggctttattgccagcccagccacagcagactagaacaccaagtagacttctaaagtttttgactccagtccctggctcccagatggcatctctgaatctgccacaagcctggcagaactcaccacccttaaaagaaggcctggatggctttgccacctgcagactgtagagccctatggccttgagcaaacatagatagtagccaggtaatggttacagcaggccttgggcaagactcagtgctattcttgcttcagctatgacacagcatagtcccagtggtgatggccacagggttttttctatgacctcacccttggctccaggcagctcagcacacagagacagactccatttgtttgggagaaagtaaggcaagagaacaacagtttctgcctggtaatgcacagaacttttctggagcctatccaagaccaaaatggcaaaacatctacaagtctccaagaaccactgtgctattggggttgggatgctactgatggcagtattgtttttcctactgattgacagtgttgtcacagagtaaattcttaaacgaatagcatagaattcaaatgatcaaaagcacatattatcagggttggaaaaggaaaattagaaaaccatacatttattaatttagtcagttaagaaatatgtatcaagcacctagtcattgtgccagattggggaatctaggtacaaaaggtacacaaccagcctggaatggacctccagtatggagatgaaaataattataggtagtgacaatggtgacccaatgtagtgcactgcaaggacagaaaagggtagaagatatcagatctccatctctacactcagtcacttacacttagcaatgtgctaccaaacagaagatgaaaaggagggaaaaatggaacatgacaggaactccctctgcatatatttacaggcacaatgtccaataaactggtgaaagaaaagtgtttctataaacgaccttagcattctatctttcacctgagccaatagttctaaatagaaaactgtgaacatgttttcacaattaaggtgtttacaattacatctatctgtaaagacccctagatattgctggcatacaccttcctcattgcccagggcttctgagacttcacactaccttgtctgtataagcctttggtggtgcttcttctctccacttataaataggatgacaacagcaactgtgactcttgccacatgatataaacttactatgagccttatcaggaatgagaataccagagaccattgtttcatgagatgatgaattccctaaacgtgtaaaaagacaatatacaaacaaatatttaatttttaaaattgtttttcaaaactgcagcaggaatcagcatgtttttatctgacataaaaccaaaacggccttcaacatctctttgtaatagtctcatgtgctcagacactacagacaatcgtcaatagaaaagactgtcaacttgaatgaactcaacctgcatcaatatttttccagagtcagcaccatgcccaaactaagagaaacatgcagttacataaataaatgaatatggatgcatgtgcatatatatgcatttgtatatacacaaaatgaatgtgaatatctttctatatctgtatcctagctttaattccatctccatctctatgcacctgcatatactcattcaactaattcattcatctgcataaactcattcgatataatcccctttagtcaaacccaccactgaattagtcttccttagactgctgccactggaagatgaagagattccaacaacactgcaaaaaaatatagcaactaaacctgtcttaatcaatttttaggtttcaaacagaggttcttaatcataagtagtattctattacctgcaagatgatttgtattcatggaagtatactataatccttaccagaaactaataatgattttaataaacttgcattgacttcagaggtttcaccatttataagttgcttaattcagtctttgtaaaatcattcattactctttacagacatcagctggggaactacaaggcaattattagattaaactggatttaaaggttgcttttattgtaattgcaaaagaaaaaaatctaagttttcttaaatattatattgtacttagacaacagtttaaactcttggtgtgagtagaaaggctgggtctttggccctatagacagctttctccagtcagtggtttcaaaagtatttactttgtaacactggagctacatctccttaacggtttgctttctcacttatttgagaacttttttcctataacgtgaataaaaagaagaaccttagcaccccaagcaccattttttaagttaaatacttcctttatatgagaagcagatgctgtcaatagaagtcacccgaattcagcaagcagttagacgattaatcaacttagaatataaatccaactatagttgttacttataagggaagttgatgaaaagtacatgtcctaactctcctatccattgatataatcaatctatcaataataaagtattaattagaaatattttcaggactttggaggaaacaaacaattatacattgcttccacatgcaaatatttcacaatttagttatagtgaaatcccttaatggaaaagcccaactaattagaagaaaggctacaatgaaaacatgtactttgtattaaaaagcattagacactataatgtgtttcctatcaaccatgcctcaaagtttctcctacctgtcctggaaacacaatatagctattctcacaactacatatatccaaaattaaacaattatgctgagagtgtttaattcttcacttcagcttccagcatatcatactgtcaatgaattaacattcattgacaatctactatgtgcccagtactgttgttgtaaagtaaggaactcaaaaacaagacatagtctctaacctcaagatcctcccaggagaggaggggagacccatgcatgaagtaaaacacaatgctttaaggtatagtcgaggaaagagcaaagtgccacagtggcacacaagagaggaccattagatctcagaaaatagccagggaagtaatatatgagctagatctttttcagaggaatagatttcccagtaaacattaactggatgaatcacagatagggtgggaaaggaagaagacttactaaggcagagaaatacaagcacagcatgatattttttgagtggaaagttcagcctgacaagagcatgaagtacattacatcagataagggtaagtccaagatgaggccagcaagggaccctggccatactgcctcagggttttctcctatagccactggggaatgataccaaagtggacagtcaaggaacagatgccaaaacccttgcaaaaatccccaaagcaataagggggactcaagctaaatcagataaatatagcatgaaaagaggaggtcaaatttaagatgcatttctgaagtaatcaattatctcctaagctattgcctactgagtttggtggaataaggaggaaaagagaaatcaagtaagtctgtgagttttcaggctttcataaacgggtatgatgatgccattaactgagatggaaaatatagaaaatgggagagaaaataaggtcatcccttaacatgtatagcctgagattactgcaatacatttaggtgcaaatatccagtgaggaggtatgggaaagtaagcaagttattttccatgcaacttatttaggaacaatagcaatttgatttctgggttttccatttatttaagtaacaaaacaaaaataaactgccatcttttaatctattagttgaatcactcttggtaacctctggcctatcaaactgtgcaactgcccatgctcccaacccaactgccacaaataaactcttcttctatcaacctcttcagcaagaaagcattttgccaacataatatgcctcagcagaccttaaaataatgaagttggaaaaatgtgggtgagcaaattttgaagtatattaaacctgacaatttaatatttatgtaagctgcaagtgctaagcataattggacttaactattggcttaggtttaatgggttgtgaatttaacttcattatcatagttttgcctgctctttgagctcattcaaccgaactagagaaaaaaaactgagagccattttctacctcaccaaaaccatttttgagatgacctgaaaccattgggtcaaagaaggcggattctttcatttcacaaaagagaagagcttcagtgaagactcctcagtggttacagtcagaaaacaaacatgggtttactctagatgggctagttactgtgagtctttaggcaagttactaagcctctggaagcctccatctctacataaatagggataatataaaactttcaagatactgtgaggatgaaaggagaatgtacctaaatcacctggcagaatgcttttgcacatgatgtgacatcagtgcacgttggttcccttcagcactcatgccattaccttgtgcttcaacagacttacaccacttccaggcctttctgctcatctctatggaagttggcaacataagcatactctacttactagggattgatcatcctaccagctattacagccacctctctgatacgatttgtagcatgtaaatcagaagcacaggtgtgccacagcatggatgagtcctttgggtttttttgtttttgtttttatttttcggggagcgggggtgtcgaggggtggggatgtacatcgtatactatatcatcctaaagaacctaaactaaaaggatccttatttcattccattttatgctttataagcacaaaacaatgaatggatctacatacaattgtggacaaaatctctctgaaggcatgtctccaggaattcctttgtggaatgtagtgatgaggaaaggaggaaggaggttccaagggaaggaaaagaaaggagggaaaagtgtccaaataactgtctttacatgcattcacaaacacacacacacaccccctcacagtagccaataggcatgattctacaattagagaatgctaatgtaatgccagtatgccttgaggaagatcacagtctagtcctttcatgtggggaagaaaagccaagagaaggaaaatcaattacctgtgaatagcatcttacaggggcctctcaacctaacaaatgaagagacatgaagcatatgcagagacatacgtttcctatgtgcaagcatcaagaatccagaccatatgatgtataaaagagatgaaataagttttcaatttatttccagggagtaaataagtaactgttgaaggagggaaaccaaccccagatgctatttagggcaccaagctttacttcactacatgatgcttgatattctgaaatccattctgcctttctccctttctcctaaacacctccaccccttctgcacatgaaaacaatgctaaacagtcttttcatattttgtttatattttatgctagaggaaggtcatttttatatctatacaataatctctctcacctccttagttgccacattttaagttacagaaactttattcaaaatgttcacaaagcacattgcttaaattataaatgaatccaggatctgtcacagttttttttgtgtgaccaaatttgggcatctctctctgtagaagcaggacaatagtcttaggtaaagaaaaccttacttgaatgcttaacttcaacagaagcccaatgggggctggagcagacacataaatcaatggtagaatgctgactacctggggctgcagggtttggaatagttgggaagacattggacaaaggatacaaaattttggttaggagaaacaagttcaagagatctattgtagaacatggtgagtatagttaatattatattcttgaaaaatgctaagagggcggatataaagaattctcaccacaaaaaatataactaggtgagttaatgcatatgtaaattagctaggtttagtcattccacagtgtatatatacttaaaaacatcatgtacatggtaagtatctacaattttgtctattaaaatctgtaagcatataaacagcaaattaaaaaattcataaaataagtaggaatagggccgggtgcggtgccgcatgcctgtaatcccaacactttgggaggctgaggtgggtggatcacaaggtcaggagtttgagatcagtctggtcaacatggtgaaaccccgtctctacaaaaaatacaaaaattagctgatcgtggtgacacgcgcctgtaataccagctgctcaggaggctgaggcaggagaattgcttgagcccgggagggagaagttgcactgagccaagactgcgccactgcactccagcctgggagactgagcgagattctgtctcggaaaaaaaattaaaaaataaattaattaattaaaaacgaatgggagtggcccctggttataatgccatttgcaatggagaatgaccatctcctactagagctgccatgccaaacctcgtggagattcatagaatagtcacttaataaataaacacaaatatttattttattacagtttattgcaaatctaggatatataattttaaggcaacctagcaataagtttaagggatgtttttacattatggtggactttataggaaacaaatattattcttgtgtcacatgtttacatgtcaaatataactctattcaagttaacatggaggctgcctgccacacttgggctgcaaacatctgtgattacaggatgtcagcttttacgacgcactgcattctaatccgataacccagtacactgtttttccattattcaattccgcatatagctgagaataggacacagtatttctaaacctttttttttttaatctagacttctgtataggatatatctatacattacatattgaattgaagatattactgttaccctattaacccggataatacaaatagttgaactaattcaagttccaaagtaaaatttcatgacttggatgatccagttcagctgtcatgaaatagggatgaaaaacggcacattataaaattttagtaaagtattttgcttatactacaaaagggccagcatatggtattcctaataaagagattagataggaagaacgagaggtatttccaaactctagaatgccacttagcaaagcatcactgtggtatattttagcgctccctgttcacccagcagagcgctcaaatctaaagcaactggtatattccaagagagtcacttagaaccactcagagactctcagtgtctctcccatatcttcttatggcttgacccatcccctgctccagggcagcagggaatctgaatctgaattaactgtccacatatatcaaatcagccagaatactggaaaatcacggcgtttagtacatgaatagcagttgccattagagtactgacggcaaatggatgatgtaaacagaactttgaaaatgcaccgaaaaaaataaaaaaggaagaatagaagtactcctttaattttcttaattctggaggggtttatggaaatttctcttcagggatcttcatgaatcgggccatatgtactttatctctacaattgggaaaggataagtggcccaaagagagtgaatcagcacaagtcaagtggttgaggcattttgcagagtgatgagactcagacaggacttcgcaaagaagcaaccaggtgaaaaacaggcttctcagtgtttcccacatatcacctctataattcagaggaccagagtcatctgtgggcaaagtgcagcacaaccatcaacaaaaacaaaattctcacatcttgtctcatcttaaaagtgaatgagaattttacgtttgtctcctcaatgaatgtaattttaatattaaataatccttgttttccttcaatctctgagaaaagctgatattccgggaagatgagacatattaactttatcatttcacatatgcttggctgcatcccaggacttgagtgtgttcacgtggcagcactggacagggtgtttaggaggtaactccataaagggcagcagcacagagcataggaaggatatgggatgtgaagtcagtttcttcaaggtcaggctctgtttcatgttttgtggttttgtcatcttttcttacctttattttagattgatgagttgtgaaaagcattgcccttatgatagaagtatcatgaaaataaactaaattaatatgtgacaagtatgtaactggatgcctgaatcaggtggatgtgcattccacggaagcttgtgttaccatgtgaagatctctgctcatccatacacaaaaaccacagaacaggagcaatttagcaccactcataaaacagggcacttaaagagtaaaattaaataaaaattataaatcaacacaaaatccacatttgaacatcactatttaactcaagtttatttttactaatagctggttataggtactaaattaccctgcaataaatgatttgctcataattcataaaaatggaagggatacttgagtattttgaggttttcccttaatcatttgactttttccttccttttaaccgtattttttccttatacaaataatataaaggagaaaaaattcagtatatttcctacattaaaaactccaacataaatgttgaataagacaagattagattcatattaagttctgattacgagctgagctactaaggctcactgtagctcaggctccctattagtaaagtgggagaactaattttctacctatccctcaggactgatatcgagattaaatgggctaacctgtagactaaagtggtttaagagtagcacacattttaagtattttggcatagcagcacactttttgttaagtgatctttatcatcatcattattatttgttgttgtgcaaacactgctctttctgaactgcagtgcacccatctatttcaaagagataatacttcacaggattgctgtgaaaagtaaaacacatatatatattttttgtaaagcacttagcatactgttcggcacatattaaatactcaataaatggtggctattatcaatttcagtattcagaggaaaaaatctgaggcactggaaagcctagggtttttgttcaacattacattgctagttagtgtcgattctgggatgggatcctagtttttctggtgcccagcccagtgtcccagccacaccacatggtctcctatagatacctgaatccaaactaaaaaccaagggctgatgcttctttcctctctgttagacaaatgaaaacttaaaccattctatttgaacagcaaaaaagctgcgaaagtcaaggagtgggcatgctaagcaccacagactgacctttaaagtatttactcataaatattcagttcaatagccaaatgccagtcttggtgcaccactgtggtttcattcactgtttgaagttacagggacattatttcatccagtctagttctgctgtgttattctacttagtttttagaagagctttaatttcctggcactttttattttccatataatcatttcattaaaccatacaacaggacgtgatctggtttagatgaaagggcaacaacaagccccagaaaaataactttactagccagctgctaacatgctgaaagtaagtttttctaagcctagctaattacattaacattttccacatcaacaaccattatggttttatattttcatgttgaaatattatatggtcctccatctaaatttatggtttattcttttcataaatactaggatactcaaaacacgtgatgaaaaaataacatatccaaaagattacatttcttataatcactaaaatagatgtaattccttacttttcacaactgagaatgtttttcttaatggtatcccctgtaaagtaagaaaataaccaaaaagctgattgttcatttgttaaacaagaatatcaaagttaaatgagcctgactctgttctaatcagaggatatatatttttttaactatcacaaatattggtaggacttgccagttgggcaaagctatccttatgatgacgtcactaaaagatgaggaaaatggaagtgaccaaccagaacatggggtaaaggatggaaagaaaggggaataaaaaccagagcagggccaggcgtagtggctcacacctgtaatcccagcactttggaagcctgaggaaggtgaattgcttgagcccaggagttcgagaccagcctgggcaacatgacaaaaccctgtctctacaaaaaatacaaaaattagcagggcatggtggtgtgcacctgtattcccagctactggcaggggtcaggtgggaggaccacctgagcctggaaggtctgggctgcaatgacctgtgtgtgatccagccactgcactccagcctgagtgacagggcaagaccctgtcaaaagaaaaaaagaaaagacaaaagaaaaaagaaaagaaaagaaaagagaaaagaaaagaaaggaggggaggggaggggaggggagagaaaagaaaaaagaggagaggagaagagaggaggagaaggaaagagagcaggaatagcattcattatcacttccagaaagatgatgtttcaatgttaactactcctttttgtacctaaatatcaagaccttgtgaaaagaaaagaaaagaaaagagaaaacaaaagaaaacaaaagaggggaggggaggggaggggagggtttgggaggggagggaaagagagcaggaatagcattcattataacttccagaaagacgatgtttcaatgttaactactcctttttgtacctaaatatcaagaccttgtgaaaagaaaagaaaacaaaacaaaacaaaacaaaacaaaaggaaaggaagcaggaatagcattcattataacttccagaaagatgatatttcaatgttaactactcctttttatacctaaatatcctacaaaacatatctcctttacacgattcatccagtaagtatatttatatttcatattccattgtttgcttttgtatgtttggccatatcaattcaaaagcactgaaaaatgttcatttcatttaaaggccaagattaaatgtatgaatttgagtctataggcaaaggatacaactggcagctgtacctgaattaagtggaggtgtttgagtgaaactgtagatagatcatttgagaggctgtacaatggagaaaggaagctgttcaattaaggtgttagaagcaaatcggaaggtaaggaaaaacacaagggtcacttgtcagttattacatgggaatgcattggtcagaagaagcaagacagaagaataagttaatgaaaatccacatgcttcgaacttggacacagggagaaggatggcggtactattgactgaaataagaatgcagtgttttggagggatgttcactgaggtgagaagaggatgacaacttctgggggaccctgaggctggtgggaccacccacatacaagtggtacctgcctcaacttttctccagtagagaacaatgaagacatttcacattcttttttatgcaagactattagcatgttttaaacaattgcctctagagtgattatttaaaattataatcgattagtttaaatcatgatgtgttctgtgattgggtatggcattgttatgaactactaccgtgccttcagactgattaggtattaaaacttacaaaaaggaaaggattattaataacaccagtagttagtactttcatgtgtttatattcaacattctgtcaataacaaaaccctaacatttattcattagtaaaaaaagacttatattttacttatatttggtgtgcgtgctgggcaaagggtaggatgtcttagctctccattacttccaacacataacaggtattcaaagaatgttacttttgaatagactgaataacaaatataaaaaagcacatgtagattaagacaaagttactctgcaaatgttttaaaagagaaatggcattctttcatctcagtggcctcttccatttctagaagagagagcaggaaggggaagggaaaggtactatccctgacattaatgctaagggtgtaaacattataatatcttactttgccttccttctgggaaacagagcacttcaaccatatctagaaatacttgagagactattctgctactgacttattttttttaaaactaaaaataaatccaagtgggaataaagggcagattaaaatatcatagcatcacagactctctgacatcatcatgctgtgttttttacccaaagtttgaatctcctgcctctctagcacccccagaaaatgatcactcacctctacctcctaaaattgccctggtaattttcaggaagctgagatcattccagagttcttcctgggaccaatccaaaaatctgccactcgctgagcctgatttggctgtctgcatgaacacaaaatgagtctaatccctcttctacatgacagtccacagaggcaaccaccagtttcataactggtttagttgtttttcttacaccctgagggaccaggagaattacattttcacattctcagcccaactgtcttttctgcaagaactttcctaaatgaataaatagtctgtcattttagaactagctcttatcaaagaagagtatcgctattcttgcagttttttttttttctataaaatagtaaagttgtgtccttcacattatggtaagtctgggaggctattagtgagaatatgagtttctctagttttgttctgttatttgatatagtgttatttttaatatactgtcattcagatgtgaatatgacatgattaatacattattggtaaatgtcatttaagatatgcttccaggagaagcaatggtattacactgagctttttgaccctcattcttcatatttgtgaattcacctatttgctaaagtttatttgtaacctccaagtcaatacttatggtgatttcagccatttcatacagtggcaaaatatttgagttgcccaacacatgcagtcacagctaaggtcaaacaaggcaaccagtttatgcatttgtggcaaatgagactaatgagttcagaggtttgatcatcccatgaccaggtataggtttattcatagtaaaagacctccctgcctgtattcagtttgataagatgccacacagattaatgctgaatgttgtaaggaaggccaggataaatgagggtagactgaaatagagaagataatcacttaagtactctttaggactgagtcaatttcattttccttttatgtagagccctacaatgtagaatcctacagcttctcatatctttgcaaagataactactacaaaggagtttatgcaagaaataagagggcatataagggatctggcacattgggatcttggacctttagacatgagacaaaatgacaaaatgagacaaaagacatgagacacaagacaaaatgacagacatccggtcactttcaggaacaagtatctgttagccaaagtctacgacagagttggacaattacttagccctgactagtcctcatatttcacaaaaagtaatctacatatggcaagtaactccaccaaggaagagggcttcctattttcccactttctgaactaaatcagctcaagctacttttaaagaaaggagagcccactcttgagacttctttgctccttcttttgtttggcctgctaattctttctccatctgaggggtgagaaagacttctttttagctgtctctttcactgccaacctgctttgataatgttctgggggctttaccagaatgacattttagaccactctaactcagcttagccactgaagctgagcacagctgaagaaagcactcaattagcaactccaacttcaaaggctatattattctctcctcaatacacatgtgtaactcccattagcgttaatgggagctgtgggagcccacggctcagagaatatacctccaagtctgtttgcttgatgagcatgcaattaaaccttatggcccaaatttttcaaggagggcatagtaagtacaccaagcactcatgcaaaatcaagtgtgcttactttgagaaaaagtaagctatcgccactatttaaacatgaagaaagagcagtctaaattaggtctattttaatttcatttgtcctcttaggtgtggacaatggcctttcatggtgttttgaggaaagtcactcctcttttttaaaaggtgaattatatgtttttagaagcattagttcacattgcttaaaagactagctagcctcaagggtaaaaatgtctaataagaacaaaaccattctaagtgaatttcgtacacataaaatccagcatggcacctatatacactcagtggcttttcctgtctttatttaatagctgtattctaacttaaaattaggaaaaaaattgatttgacattaaaaagaaaaaaaaattttgagaggaaaatgcatgccccaataataaatttgtccttatcaggaagtaataatttccgtccctttcttgcattctaaagagatttgtccatatattttcaacatgaaatcaatatatatttcagcttcaatgaaatatcaatatatgtcagctagtctgtgctacagccacagtcttgaacaacatcttcatggggaaaataatcttgataatttagtaccatttaaaacaattccttttctattattcagacattttccccaaaatttaaaaagaaatttatgaatgaaagtttttacattttataaaggagagttagctaatcacttttaaagtcatacaagtgaattgttgatctactattgacacataattcactctaccaccaaacctcatatcctgactttctaaccacatgaggcttttttaggtactggaccatcagtacaaatcaattgaagtgcaacgggccaatgaacttatcagaaagacaaaagcgtccacactaagcttatgggaatgtcgagatgtcaggagacttttcaagttgtaacatggcagatgagctagaggaaaactcctttaaaatttcatctagtacatggtcttcataacttcattttgcactaaatatttaacaccttgctttacaagtttgataactaccatgtcttcataaaatttcaaagcccatgtgttaaaggaaagaagtatttcaaaactgaacacagggatcccttacttcagactctaggcagactgaataaagaatgataaccatagattagataataaaccgtggtctgtggttaacagaatttttaatgatgacaaatgtgagaaacattcactatttcttatcaaaaaaagattgtggtttttctctcatatctgcaatcttattcataaagttgaaagctactacaatagataccctactttcagagcatatctcacatacaaaactacctttcaagtgagagataaagactgccgatgttattacagaggggctagacagttttattcttagatgttttggatgtgatttactctggctaaaaatactaataatttaactatgctattaatcctgctgaagtgattatgccctccatgagaggctaagctgaaactcatccagaccttcagttggcacagaacacactgatttcctcatatagaagttcagttggtagtggtttaatcggggattatcagtgtataaaatggcatttattcgaacacccctgtgagtacaaccgtactctactttctataactgttgtccaaaatacttatttacaaatcctttttttcccaatctggctcttctataagagataaaaatatattttcatttgatataaaccaaaatacactgagagttcatgaaccttggatgggtcaagggatgtgaagtaaatcaatgagtaataacagcaattacctaaaatacttgcagaaagaaggaagagagagaagaaagatgggaaagaaggctgggagaatgaagatgtctactcagtgtctctgatgagggttggtcgatgaagcacccatattatgatctgagaggcagctgagatttgtgcacttctcaggagagagaactgctgtctcattttggagaaatgcttataactcttatcaagtggatgtgcaaaacctgatgtacataagtaatttattcctattcctgattactaggctacaatcaacatcagatatgtcacttagatgtcccaacttttaaaatttactgacatgtattatttcagcaacatatttgagtcccttctctgtagcacctcttgtctaagtactgggataagcaatactgatttcattcctacttaaaagaacaaacaaaactactttgtttttaagtcttacagtcttgattttaaaaatccaaaaggcttgaatttaaagagtctaaaaatccttaaaatgaaactcttgagtagataaactttcttaaaaataagtatttctataagtgtatttatatatgtacataaaagggtgaattcaacttctctttatctttagactcttgtaaaagttgccattgaaaggcacatctgatacggcaatttcagcacagaacatactcaataggaaacaactaactagagaactaaagatgtaccgtctttgagtcttgctcattttttaaaaaaatcactaactttgaaactggtaggttgtcccacttaaagctcttgatttttaattgccatttctttttacacccaattaaattgtcagagtagtgaagaattgcccaactgagtagaactgtgaggatcttctcactgctgctttccgcagtcttaatttgcagatgcttttgcctaaaataaaaatttaaagtcacttcctcaacaataagacctgtaaagcttccaccaactgctgtttaagacagacgcaaaaagaaaatttgctgcacgagtttggggccatagaaaaaggaatattttcctatatttgtaagatatttgggttctgaataacagattaccatgtcccttaatctgatacatattaaatgaagaccacataggtaaagggcttggtacctttcaattagctcagcaagtctatcaactggtaatattcaaaaagaacaaacaaaactcatgctggactgttcattttcatgaaaacatattgtgtataaagccatgaatggtgatcaaagattcctgtgaataattttcttaatgaaagaggactaattacttgctagattctcagaccaatggtatggtatcttgacaatctccatctaccagaggtttcaaagagaaagccatggagtcataaaacaccaagacaactcagttccaacatatctgaaatgacttgccctcaccttttaacttcctgtggttgcctcaaacatttaagaaatatctttattaatttacttatttattcttgtttttagacagagtattgctctgttgcccaggctagaatgcagtggtgcgatcttgactcactgtaacttccacctcctgggttcaagtgattttcctgcctcagcctcctgaggggttgagactacaggtgcatgccaccacacccagctaattttgtgtgtgtgtgtgtgtgtgtgtgtgtgtgtttgtctgtgtttttttgtttttttttttttttttttttttttaccggaaacagggtttcaccatgttggtcaggctagtctcaaactcgtgacctcaagtgatctgccaacctcagcctcccaaaatgctgggattacaggattgagccactgcacccagccatacatttattttttaattgagacataaaagtgtatttaccacatacaaaatgatgttttgaactattatgtatacattgtgaaatagttaaatcttgctcagtaacatacgcattatcttacatagttaccacttttgtgtttgagaatactttgtacccattctcttagcatctttcaagaatacaaaacattatgaactatagtcaccatgttctacaacagttctcttaaacttactcctcctaactgaaatgttctatcctttgaccaccatctccccaacccccacccctcaacctgctcagcctctggtaaccaacattctactctctactactgatatcaatttttttagattccacaaatcagtgagatcccatagcatttgtctttctgtgaatggcttatttcaattaccataatattttacaagatataaagaggtataacaaccaaatgcattaaaaaaagaagtaccctcttaactagcctttcagtgataactatgtcttctttaatgcctttttaatgcattttatttttcacaaccattcagctcttacatcccactccaccccatctttttgtgttctcagagctctctttctacccaggttacacagaaactcaaggacgatgactaaataaatctccattacacaaccaactcagcagcccctcttggtggagttaaggtatcttttacacatcttcatccttttcctagagacccccaaaacaaaaaaaatcaacccttacacttttctatgtcacattacactcgattgtatcctttgcaagatagcattaaagggcaatatatgaagtagtaaatacagaataaactttagagtcagaaaatctggtaatcaccacatttaccagcatgtttggtcaagccacctctgaatctcagctgctctgaacttgtagcctctccagacactgcacacagaccccctttagtagtcagtaaagcacttagcagacctctcctttagggctaagaatctatcagaacctcagatggaacacctatatattaaaattcacacattccaaaactgcattgaacgcttggtaattactaattctctaggatttttttcctttgtttgatctttgcttttctaattgccaataaaacctgagcaagcaaatagaggttctgtatcatttgctcattgagaaaagaaatctgaagatcttctaatatttatcttacagacaaacgctttaaagaagaagcctaaaccattcctgccttctacctgtctcttctcctttaataaacaagacagcatgccgctcatggagaatcagttcagaaattcatttgttgaattttagtaaataatgccactagactttagagctagtttacataaaaataaaaattaagaatttatagtgtctaatgtcttgatgaaaaggttattttgcatcagtgatggtggtggtggtactgttcaaatgcaatgagaggagatagaaaccttgacctttcagaatggagaaattttaaccaggtacagtccagttaatggcggggggcagggggtggcagggaatcctgtgtaatgtgcaaaaccatcctgttacaggagagagcagtggatgtgtactgcctgtgtagtattgtatgttaaacagtaaaggaaaaaaatagtaccaagatgttctccataaatttagaaacagaattataaacattgggcaaagtcctttcaagtctatattaagccatggaggattgtgattcaggaaagacattcacccctctacgtgagactcacattcaagtgctgatgtacacaagtaatttttcttcaatcatatgtaaagtacaatgcagttcttagatcccttggccccatcccagcagcggacctagatattattaagtctaaagcttacgaaactttaaaggactactttatgaaaacaaatgcaaaaatcttatttttacaaattttagaaaaatatataatcaaccggagatactagtaagtcttcccgggtctttggaaggcatcgtacaagggagggccctaattccaaagattcctcaactgcagggtaagcctgtctctgcttcaactccacaccaattacttcccctccaccattctgagagagattttctggcacccgagtatggcaagagtttggtgggggtcttcgaacaagaattcatctcactggaggacacaggaagcgtggtccctgagcttaatcaatgctgttagcatatagttaaccaggcttgtgtaaaagacatcacatcagcatttcaccattatgcggtaaagtaattttaatttttaaaaaaaatttgtttgtttttaaataatcacaatcatatcttaaaaatgttgatagggaattaagaaaagattggctcaaaccccagtcgtactgggcaaaaccccagtcctactgggcagcatttagtgtcctccttggttctttgtactaggtttatggcaaatccttgagaataatcatttaagtcagagtgaattcttcctcccagatgatgatttatctgtttgtaagctgagatgagggaattccatttgctattgagccagtgagtgttaactttattaacgcatctttgcaactaagattaatgggacccatagtaagtcagctgtagcacttgatgtcagtttataacaagcttggcaatacctggaaattcagatctatcatcataagttataatgacatgcataaaaatttgagtgtaaataaaaggctctttaggatacagggctctaatccaagttgttcaagccttaaaaagtaacttatataacagtgttcctgttttggagtacagtatatgctaatggcctttcctcaagggttaaaatgcctaaactaccatcttctaataaataaatattttattacaaaaatcaattttgcttaatgaagtcctctgagggagaagatgttttaagacattttaccagtacactttaaaatcattttgtatttaggtatgctctgtcatctccacctagagcaaaaaagaatcataaaaaatgataagtgcagcaataaaaaactcctcttactattagttgggagagaaacaaatgggtatattactctgaaggtaattacttaagtttttttattgcaccatattttctcaaaaccgaaccaaagtatatcccaaatcttcctacaaatgaaatacaatttttctctcagaacatttttactcatcaggacaaaaaggtgagcttaattcttctgtcagctgaggcttcatgtgtcaaacacatcttacatttcaacaaaccttactgtcatattgatggaatattcaaggagacattagttcttacggcaagtactagcttgaaaaggtgtaagctgaattactgtgagagcacttttcttctaaaaatagactttattatctccaaccacagtatatatgtataactgccttgtcattttaaccaaatttatggcttcccatcagagattgtagcttccttgaaggcaagtgggggtagtttctttccatctttttattcccaacacttagcacacttcctggactagagagagctagattatcaaatgaataaattcatgaattaatacaaattgcttctcatatattgtatgcctatccgagatgtggaagcaacatctcctgacatttctaatttttaaaaataaaccttaaatccagcagtctgcaagaaaataatatttagaaactttttcctaaaacttgtcattcattcattccatcaagaaattttggctggtagcagcggcttatgcctgtaatcccatgactttgggaaaacgaggtgggaggatcgcttaagccaagagttcaagaccagcctgggcaatatagcaagacctattttctaaagaaaatttacaaaatacaaaaaaaaaaattagctgggcaagatgactcatactatagtcccagcaactcagggactcaggtgggaagatcccttgaacataggagtgacaggttacagtgagctatgatctcaccactgcattccagcctggatgacaaagtggtaccctgtctctaaaaaaacaaaaaacacaaatgtttatggaaaatgtcaggcactgtgcttactgccatgtgtacagtctagagcaaaacaaagccatgcccttatggaacttctagtctaagcatgcaactaactctgttttttaggataaaaggaaaatttcatctaattttctcttaagtatactcccctatcacttatgacagaatgatgttcaaatttcaaatattttgtggatcctacaacagccaaatggtggcatctggaccacatgattatttagtggacaaggtagcttgacttaaggattaaaaaatttgtgtattcccagccttagcaagataattctgcctgtgccaaaaagttctgcttcacaaatggggcagttccctttaatcaaataatttgaaattaactcttaataataatcctactgatcatagtaatactagtgatgataatgataatcacaacaacaactcacatttcctgagtgcctagaactttgctaacagctttacatggattatctcctgtaatcatcctcttaagtttactcaataggtcttcttatctcgacttgatagacagatgctgaagcttagagaggttaggaaatgtgcacatttgccgcaaaacaaatagtgaagttaggatttgaactcgggtctgtctgtttgctgaacctacacccataactacaccttctatcacttcctacaccaaggttggtaacagaaataatcaaaaaaacaaaacaaacgaataaacgaaaaagcaagaaaatgtttcctattatctctttcaaagtttcaaggatatttgaaattcttctgcttcttctaaaatatatctaatgttacattttcacagaaatcataaaacagttatagatttttatctagtctgtgacctagatgtcatagaacagaaataatattctagtacgacagtgtgactctagtttgagttaggcagttgaagcaattgactacctggacctacctaatgtataagcattctgaagaatatggaaatgtgtgttaacgtaacaataagcacaaatgtaacagggggaaaaaaaggaactaaaattcttgggattgtgtactagcatagcaccaataaatgattttcagtctttcaaaataacttggtaatactgtatgttttcagattgttgtatcatcctatttccttgtgaaaagctgtttttcagtcctttggattaaggactatttgagaagacacaaaaacttatttttcagagttcttcaccctcccttcccttcaccatagccacgtatacatataacacttactgaattactatgtgcctagcactattctagatgctggggattcagtagtgatgggagagccaaaccagctagctcagcttcaaagggataataaagggagaaggaaggaaattaacattctttggcaactttattgttagttactctgccagatgatttaatatgtcattaacttcccccaaaacagccctaaaagatagccaggatcacccccaaccctacagataggaatttaacattcagacttgagtaatgtgtctaaacctatacagttaggaagcactggaaggttgatacaaattcatgcttatgtagctagaaagagcatctctcttcattccctctgtttcactctgtctttgtagttctctttccctttgcctcgacttcttgactctcaatcacgctcttcatcttgcagaggccactgaaataatgactattttgttcattatatgtaaagtaagactcattcttacccaaatggtctcttaatgcattgtatctacataaccatatctatagatccctctacatatgtacctgttcatgccacaaatatctcttgggtgcccaataaatgccaggaacatttctaggccatagaaaactgtaatggagcttatacacaaaggaagaggtatacaggataaaagtctcaagacataaagagtataatttcacatagtaaaaagtgctatgaagcaaattaaacaggtcatatacaaacacactatatatatatatactacatgtacaaaacatacatatatgcaaatataccttctcaagtttttgtataaatattgatagttaataactagctttattaaaagccatcacgtttttatgagcacatacttttctactatacttaattttctagttgaccagtaaatgacagatctgcagttacccacgtaattaaacaaatacataaacaaacagaaagaactatgtatgccgatacttagaaaggtagaaaatatctaaaaactgttaatattgattttctggtctcacttatgatttatagcttcatttttttaatagctcttttggtatttatgctccaagaaatataggatctcttctgggaaaatacaaactatgatcaaattttcaacctgaatacagacatcatcagacatgtgagaaaaatctcaatagtgctacacttatgaccaaaaatctatcaattaaaaaaaaatctactgtgttaaagggtgaaaataacatttatgtaatgcatggataaagtttaataatcaaaggtaaagttctaagaaacaaaaaagaaaggcatggaaagtttttagatataaattaaaacacagctcattttggaagatgacagataagagagtcttgaaatgatatgactattccccgattgcccagtagttaaaaaaaaaaaaaaaatcttgctatctttaacaaaacatattaagaatatgggatgtgtgtcatcatagttgtgtttaatgtggcattaattcacaagtcattgtttttttaataagatataataagttacttgctcttctaaggagatacgtaattagggctttgataattaaaccctagatgaggcatttggcatatctgtgccctaaataccaataaattatgcatgtacaacttttaaaactacatcttaattagtagcttaaaataaaactaatttggaaaaccaggatactgaatttttaaaaactgctcaaattttatcaatgaaagccaaccaactacctagttttaaatataaacctcaattatgtatgaatgactgtttgatagattactttaagtgaagtattttagtaaactcctttgtaattttcagctcacataaagatggcctaggttaacttaatcacaccttttctcacttattaggtttatctccttagccaatgagtcacgtcccaacctcattttcttttactactactattttacttctgctcaattctgacctaccattgtttatacccacctgtaatggttaattgtacgtgtcacttgattaggcgaaatatctggggtgctcaaatatttggtcaaatgttatcttgagcattactgtcagggtgtttttggatgcgattaacatttaatttagtcaccaagcaaagcagattgccctccctaatgtgggcaacccttatccaatcaggtaaaacactaaagagaacaataaagctgagcctcacctaaggaaggaagaactcctcctaccttcaaactgggacatcagctttttcatgcctttggacccaatctgaaacatcagctcttcctaggtcttcagcttgccagcctgtggactagaactgcacatcaactctcctgggcctccagctgccaactttggcagatcttgaaacttcttggcctcattaataatgtcagctaatttgttaaaataaggctcttcctatatatgtatatattctgttggggttctctttctccagagaaccctaatacactgcacacacctaccatcaatactcagtgatttcctccctaagccactttgctcaagaagcttctagtttctactcctctctcaagttagctctgtctcacagactcctaaatattcttcatgccccaacccagcagtctcctcactctcacagtgtatcatccatgtagcattttacacattttgcacccatggcacttgagcactttttatttcccatcatgctcatctgtcgacatgtcagctggaagaacattgttcttccaggacaatatcttgtatataaagtaaaaatctgaagggctgaaactcactgtcacacgtactgcagcagggatcacttcagacttggccaaacccgatgaaaatcttagctgtacgaccaagaacaaatcatgtcaaactctctggaccttggctccttacatcaaaaataagtagtgaggctaggtaaacaccaaattcccttctagctcaacatttctatggttcggttaacaagttaagcagcagtaaacactcgcatgagttgatgttcatttcaaaattattaaaaataatattttaatatgaagtcaaaagaagaaaattgttctcacttcaatgcaatgatttacaagtgtgctcattttttctgagccctttttagacatgatctcagtgtggcaaaacaagtaatagttccaaggaaggagcatgcatcaccaacataacagtcctcaaaagatagatcagaaggaaaatgaatagcgtctcctcacaggtacactttctcccccagattttcagttttaatgtctccccttactagggtctctcatagactatccacatgggcttctgtctttgtgaccactgatacccaaagaatcactgtttttaaattctaaagattacaccaacgaaagtcaggagcgtctgttcacttaaagtggctctgcccactaccaccttttcccagcatggaaatgaggtacacacgaaagctttatcgtgttggtatcaatgtattccaagtactcaactattttataagccttttcaagtaatcttcagtcagtaccataattgtcagcacgtttgttctgtgttggccacccttccttttgtttcagtctttcataaaaatccttttgtgtgacagtcaagcagctgtgctttgttctttaatgttcctagcctggatctccagccgagaccactttataacataaacggcaaagtaccattttcacagcggggacaactgtgttcatcttcaaaaagaggcattaataaaatgagactgtaatcaacatgctaattctgatcacagggtactgcacaatggcagagatagttgactgccttctccctgaaagattgtaaaagttgtatgttttttttcctaacaactgccataatggcttacattttttgaaacagacatattatgcaaacatttctatttcccattgcagtgccttctctgtctcatccaactgctcactgtgtgttttactatctcagtaacagtcaccttcagggagcaaattttttccatcttgcaagaactgacttgctgaaataggcatgtcaatgaatcacggaaagctggagaggggtgatctgagtgatttcatcgctaatccaaggccttcccaatgcatatcaggccaaaaaaaaaaaaaagaaacagaacagaacagggaagttaacgtatttgcttaagaatccagttattttgtgacagagctaaagctggaattcaatttcccaagacctagacttgggtacttcacgtattatcttttgtcctaatggtgatcattcacaaataatatatttatatgtaagagtaggtacacataagtatcacttgatgaaatatatttgctaaactaggtaactaaaatgcctcatatctggtaaactagcatgtttagacaataattgtactgtagatatgttctatgaacaaagccagttccctataaatagataagagcagcagtgttgtatatcataccctgttctgttgtgctagtggtggtggtggtttggggcagtgctatttgagaacagcccagtctaaaaataatctactaagattttttaaatgacccattacatgctgtttgagataagagcaaaataatgtattttctgattactcccctaaaaaaaattctaagttcaagaaacatgatgacatttagtaagatgcttagattcaaagttgattaaatggttccagaactttgtcttagagaagggaggttatgtaagtaagaataattattgatgtctttcctcttgcccaaaagaagcaagtacccttggactcttactagaaagaaaagtctatggatggtgatatctcattttccctgcctagtgattgataacatctatcagagagaatattttcatcctcagttatcactgcataaatttgtattacatggtttcctgctgatatctttagtcaggaagaaattgtgaccagcaaactaacgaaacagacagaaccaattccatttagatgacaatccctgttcttacaacactctctctggtcctatgcttgctcttcactgaaagcctgatagttaattcactgtccttagtagcattccacaattagttaaggcacagtccttagtagcctcagtacatcctaaggccttcacttaaagttctgcttaggatgggaaaacacaagtaaaacagatatactcagcctcctaaagtgttgtatcattagggagtcagtattttcttgtgtttccatagccaagacaactaaaaaattaaaatgacttggaagacataagccctacattcacctcccccctctcctacttctttcgtgaaccacactctatggtatagttaattgcccaaatatcttatttcggggcacattcagcctgagcttgtggttatccctccttattgaaacacagtttttgagagtaagggtaatttgaaacaagctacgaagggaaacttgttcctgaaatgctcccttcgaggcacatgggtggtcagagtattatttcaatgtcttcttcattaaccatacaggtcagatatttgaatctccaattaattagtttctctagtagcttgtgtgagataaatcaatgatcttcatccagttcacttagataaagcccatcatgagagctggcacatttttggcatttgtcagtaaagcagggagaaagtaaatgatccacgtggacgaaatgggaatctaatgaggccactggacgaaaagtgtaaaatggtctccatctactgcagaacagagtgcctgagtgtccgccaacatgatttgcaagagaaagtgaacctaaaatctcctcaactgtggtataaacctcttcacactcatttatttagctattcatgatgttcaaagtctatgaatgtcagtttacactggaatattattaaacactactattaatagaaataacaatatttagaagttttaagcaaacagtgactccaggaaacaaaaataatttccatccatatttattttatcctaaaaggatatataaaagtattctattttaagattatgtttagactacctttctgtcatctaaaatacttttgaatttttctcatgaaagttctaaaactgctcaacatagtctttaaaaaaatggaaagggttaactactcaaatcataaattttcatacaagtatacttacatatgacagatgttcacatagaaagttgagaccatattaaacatttttgatgcatttgttttatatggggactagctgtataaaagcagaggagatgatgaaactccagccaactgagagacaggaaaacattaatccatgtaaatttctaagtaaagtgatattttgctccaattttttgttaatgtcttcattggatgcataaagataagtcaagcacatgactgccattaattccttttaaggagttcaagggatttggaaagtgagaaaactcaaaaacgtttctgataagttttattttattgtacctttttaatataccttctatatgatggcactgattctaaactaggtaaataaatggagattaaaatttttaaagcagatgaacaaatgagccagatttggcttcaaatatgaacacctgaaaaatgacaattttcagacaagctgaagtgaactatgtatgtatattcagaaatatgtatactttccatagtgcatattacagcacatataaacatagtctctaagattcctgccagttctaaaatctaatttctaactcctattcttttttttccctaatgtcttattcttgcctattagaccattccttcctttcccttttcaaatattttaaatatattttgaaacccattcatacagttcagttacctgtggatcagagactatgatttccacccttgatggttgggcttactgtcgcttgctggtggtagctgacttgattgctttagaactggtgttcattagcccatctgggtatgaacaaccttctctagggttgtgtatctggattatcggaatgtctctgtggggtgagtgctattatgggtgtctgttgcacactctatgggactcactgtttctgaccagcttttatgttaaactatttggtcctgagtattgcacagtaggaatagtgctggaaatctcacttgtatgcagaaagctgatctagtctctgttactctcaacttattttatatacgtatgtatcttgctggagtgttaaaactccagcactaaagcataaggtccattttgttattatcttgggttattacaattgtcttttctctaggaaatccctcccttgtttttagcaactggaaatttcaatttcttgtttgtaagcctaattatgcttttaattttattttcagatactttgtcaacatttctatgtgttggtcagggaatggggaacttcctgcaccaacctagcttgtcataacagccagaaatgtagctcaaatctcacttgtctgttttaaagcagcatctgttacatgcatttaaaagatatacatccaattgtcaatactttccctgcaacttaataaggtgtttatactatttcaaacgtaattaaggatatatatgtaaataatctcattttctcagcctcttgaattgcttctttgtgtgtgtgtgtgtgtgtgtgtgtgtctgtgtgtgtgtgtgtttagtttcaaaaccaccaggtaaatttgacctacattactaattactgctggcctccaaataaataagttcttgacaatatcaatagggcttacctccttgaaagaaaccaagatgtttatcaaatcaaacttttttattttataaaagatataaagtaaaaccatccctccatgggggtaaaaaaaatgaaatagtagagaaatgtacttaatctacataagttcctctatgattctgattgtttcctttccaatttctttcatgttaggaaagtctattctcctaaattttggaacagaggaaaatacaacaaaacaaaacaaatgagttgtgtgagggagagaaagagataaaggcacagaatagttaatctggaaatgtcaactgtgaggtgcctaattgggaatgttcgtatctctatacagaagcctgaattagagacatacaacacagtcttcatcatagctttattctccagcactctcattgtaaaggaagtctacaaactgaacacactgtactggagatctggcaactcaccctgtgcctttgtcaaattgtgtaagcaacattgttggagacaaagaaagggatttgtcagcccagttatttagatcaatacatattggtttaagaaagataacagacaaataaaaaatgtattttttttcacataagacaggtgcatttcttatacttggttctgaccaattgcttaaggaaagttcatctttaggctaaggttctttctttaattctgcaaatatcaatgtcagctgtggtagttgtaaaaaacgtagctgctgaatacagtatgaaaaatccatgcacgagtaatgccaacatataaaagagtaccatatcctgtttcctttctagatgctctgccaaaaatcaaaatggtatctggcatttgaagtcaatgcttttttcagcttttttacctctgatattccccctgaactctagttctgtaaagacccaaaactagagaaggtatccactgtctaattaaagttcaagtcttacaaacatttaactgagtttcccatttaagcaccatcacaatgctagtcttttcaatgatgctacaaaagagatacagaattgtaacaatgacacaaacgacaaccttcacttgagcacttaccccgcaaaactgtgagtctggtggatacacttatttctcccacattatttgaggccacacattcataaatggcctcatccctcggagtccgtaagggttgtattctgagaactgatccagacccatcgtcaaactctattacctattagaggaaacaatagctgtcacaggtgttgttacaattgtctacctctcagctaaagctctcaatacagtggtggatccgccattaggctcataataaactaggcatcattctgaaactgaattttgatatagtggtgaaaaaatatttggtctaatttagtgaatcttctactgaacaaggagaaagatatgcaactacatatgcaaaacatggagatttctagtccctactaaaaactaccagggtttattcattaaaatatttcagtatgttcatctagggcaatttgactctattaattttgcaagaggcttgcagctataatggataaacttcttaaattattctttctctcacagcacatatacgaatgtggattcattcaataatgggactgtaaggtgaagaattaatgcatgccaccacagatagctctgctagtttaaactgtctcatcctgaacagtatagataggcaaaccacgaaaagaaattgcataaatctagtacttaggcagccaacgagacagctttcacaacccaaaagcctgatggtgtgcattaattttgccataaatcattccagtatttgttctagcttagcattttctgcatttttagagcattcttgctgtaaaatggaggcttgcttcaccaggcagaaaattaatgtcctaaacactaagcctgaattcaccatcattaggaactcttcttggaaacagtttagtgacactgataatcctgggtacttgttagctaattcaagtaccacttaaaaaaaaaaaagatgatgatattaacaaatatgtatacaatattatggagtcctctgtcttttctgtaactatgctgcattccttcagctgttcactgagaagttgtgccttttttctcttgtatttcactgtgaatattcccatgtgcctaaattatgaataaattgagattgcctcatatatatatttatggggtgcttaattccagattttgtgtgtgcatgtgtatattaacacagagaggaaggacattcatattttcaaaatatgtccacttcaatctttgtgcattccatttttgttcaaaattcacaaaaatattcaaaatggcccatttctcaatgcactacagtttattttcaactctataaagcatacactttaaaataaatctactatgcatcttaggaaagaaaagtttcatagtttcatattggaagctttgttaagcattccataattttaaaaaagttatttatgatcattttatgatttaggtaggaaaaggttaaagcaactataaacccaatttaaatgttgactaatttattaataaatgtcattgtatgtttacatttgtgaactatttcctagatttagatctatcctcttacaacatacaatataccacacattacacgccagtgatgtaatttccagtttgaaaatatccagtattgatttcatgcctgccatggaccagacaccatacttagcactggggatagaagagggagcaaaaacagtcaacatgtactgctctcagggaccatacagactagtaataccatatatattgtttaataatatatatttaataatatatattaaatatatattatatatatattagtgttaaatatagtaaagattttcaaccaaggacttgatacagtttgatgaagctgctttgggtaaaaataattcatttaccccaaaggtgtttatatgactctcatggggaattaggcattgagcagagatcatgctgtgaaatatttagtagtataatttcacttttgttacatgattttgtcaggagccattgtcattagaaagcgtgatgtcaaacttctctttgacaaaaaattaacttcatttaaatttttttaatgtgcagcaaagatgcatacatacatcattttctacatgacacaggaaacattttccaaatattaaagatatttttgtatttaaataaattatatttcaataataatcaagtatttgattttcagacataattttaaacttctcacttgtaaactacaacccaatttccaatggcaaatttctaatttcaccattgtaattaattaggttctctatacatttgaacccctgatcaccctgtgagttcctatgaaaataagtaaaataaaattgttctgaatttgtagttgctatatttcttttaactagaaattgcctttaatctgccaaactgtaaattaggtcatgaaggagattagaaactcaggtaaaagggaggtgagtttcacaatttcaggcagtttgggggtattggtagcccctaaaattaaagctatccttctcatgtcttaaattatgggcatgctattgtgtgcccataatctgtgtagctttctatatatcttattgcctatatttctcctccagaatgagcaaatttctaaaccatcagccttctcacaaacactcaaaaaaagaatctttgatttatgtttcaccatcttcgctgcactgagctctcctgaataaagaaaaccaacttcttcgataggtttctctgcaatatcaacctgtttgcatgtgtttctttcagaatagtactttaaaacactggaacaaatttctcattctagttcacactacttgtaaaacacaggtgcgaggggcagtggaccacttcatttgctgcttagcatccattcccattcttcttgataacgaggatttaaatttcctttgggaaaattctgctctttcattctaagccatgcaattggatgggactgtcctcattcccagaacagaggtagattctgattggcttaaattaagtaggctacactgtccacctatccacacaaattgtctcagggatgcacaagtaacgtaataggagccaatgggatgagaggcttctggaagagacaagctttcatacatcctacagacgtggtcctgtgaggttgcagagctccatcttgcaacctggggatgaaactgacagactaatcctaggaatactattgagccctggcacaagtagaaacaaaaatcagcccttgaacccccaaatttccttttttaaaaagccatttagagttacattttccatcacttgcaatgtaaggaataccatatatcagtgacaccttttatcagagtaaagcaagcaagtaacgtagaaaccaaagacagagcagatacattcttcccccagagaaacagaacaatggacctaatacctcaaatctctgattgctgactttctttccttttttgttccagacaattttaggtcttgggtctcccgtagcttggcagatgaaagaggcaactccgccagagacccctgtctgatcaacgggtgttcgtgtaaaccttggaggtgctgaaataaaaaataaacatcacagttaaattgaaaactgaaatacagactattatcctactaccgctgctctccccaccatcctcaaccacaccgccatcaagacatacatttttacaatgcactatgggattacaaaattagaaaagcatcttttacttttgagggtagtttaaaggggaaggacataactttctggttaagttatctattagtgcttttattgctgaaatctgtattaaggtagagatccaataacatccgaaaagcaacatcacacattaatttttattaccagtatataaaaaaatccaatttgtcctctaacaaaatgagctcatcaatcaaagtgggtaaaattttagcgcttgctttgatgccactatcaggacactgccagaaagcagcattgccactgctgagctattaaaattagtgacatttaagagaaatgctaggaaattttaaagagacaagaaatatcgccctgaattagaaggtttcgcaagaaatagaaataggggaaaatggtaaagtgactctctaacccagatattgtaagctgtcttacttgaaacttagctccacaatttgcataaaagaagatgagtcaagaagcctccaaagtcatagtaaagcaaagaatattttttatacaaagatgtagacttaaagattactaaggctagcaagatagacattggaagcttgttcaacatcctccatctcctttaaatgttcctaacattcttcctccttctttaaaaaacttacttatttttcatcttgtatttcaagatctagatagctatcatacaagaatgatataaaatgtaaatgaatacttatgcacaaagatattcatcatatcatttgtttggcaaaagagtataagtagttgaaacattaaacagtatgggatttctgtcacagtgaaataaaatatggcatgaagatggaacatcatacaagtagttaagtgttataaaatctgtatcataccacatgagaaatgcttatgatgcaataataagccacaaaagcatactacagagttatatgtggggatagcagataatgaaaaatgcacacacacacaaagattgaacaaagtaaataaaacactaataatggtgttcaggaggaggcattttaattatttctccgactgctttccatcttttacacttccttgagtttttacaattatgttctggctgaaaatgttttaaagccccaaaacattttgctgttccttcttttttttttttttttttaatttctaatccctgttacagattttctcttctctcctactgtgttctacttacatgtcattgaaaagtggttttaaataaccatagctaaaattgattttgaaaacaatccttggattataaaaaagaaaaaagtcataacaaagtttgttcttcttggttcatcaccagtatcttctctgtattgatttcatgtttcccacatggtgttcccattaacttgatggtgtgttctgactctgtttggttttcttggagtcaaggaagccggattcctatctaagctccaccaatacatatatggataatcttggaggaaaaaaaatcatgtaactttaccatttcttggtatgacatatgaaatacattaatttacaaaaattgcaaaactatgacatatgaaataaattaatttgcagaaattgcttccagtttcaaggtttcctagctttatatattatttccaaaggagggaagttcagaagaggcatatttgcaatgctggtcctggagaatgaattaccacctcatcagcaaattcaacttgttggtgatcctggaactgcgggcctgcttatgttcaaaaatattaagaaagcaaaacagcctctaacaaccctgctagagatcataacctgtagcatctcagtgtagcaatacagactagatgattactaggagctgtgggaagtacttaaaataattttattttttatttatttttatttatttatttattttagatggagtctcactctgtcgccagggtggagtgcagtggcacaatctcgactcactgcaacctccactacccaggttcaagcgattctcctgcctcagcctcccaaatagctaggactacaggtgcgtaccaccacgctcagctaatttttgtatttttagtagagacagagtttgaccatgtgggccagaatggtctcgatctcgtcacctcgtgatccacctgccttggcctcccaaagtgctgggattacaggcgtgagccaccacgcccggcctcaaaataatttaaaattgactaacagtgagaggattacaaaacactgtacattgatgtcacttttctggaaacaaatgaaaaatatattacaagtttttatatttatctttctgctgtttcaaacaatgcaaattgataataactacttgcttgtcagtaaccaatggaaaaattataattatgcaattaaaatttctagggaatttccctagaaacacaaaatagattgctgtattaaatggtacaatactgtcatttttagctaccttccttttcttgtccatagcctaaaaactgtcaaccgggaaggaaaatacattgtaagagcccagcttcccatttaagttctgttctgaaatttcttgcaagaacatgtgaatacattgaagggctgttgcataaaatgagtgtgcactatattagaaattaaagaaaactagaagtaggatacccttttccctgcatctggatattttttaagggataccgttgcatttcttaacccaaagaatgaagaagagttggcaattctgacaatctgcaactaggcaatggatgcttgggtaagtgcttcatctgtcctgttgccatgtaaggacctaaattagaaagctcatctggaaataactggtgggtgaggacaagtcaaattaaacatagaaatcttatttctaaatggagtgcagagagacaaaattcccatacacttggagaataggtatgagtgccatttcgatgttttccaggtatgtgtctcatttatctttattttctggtcaggcattgaagttttttgtttgttttttgagacagggtcttggtctgtcattcaggcttcagtgcagtggcacgatcaaagctaactgcagcctcaacctcccaggctcagtcagtcctcccaccttagcatccagagtggctgggagcacaaccacacaccaccatgcctgggtaatgtttttattatttgtagacatggggtctccctatgttgttcagcatgtcttgaactccagggctcaaggatcctcccgcctcagccttacaaagtgctggaattacaagtgtgagccatcacgacacgcagagaagtttttgtgtaatattgacaagtataaaaatatgccacccaggaggcagaggttgcagtgagccgagatcacgccactgcactacaacctgggtgacaagagtgaaactccatctcaaaaataaaaaatttaaagaaaagaaaaagaaatgaccattggatgctactgtaggattttatttctggagaccaagtcatggaatgaaattaacctattgaactgtggtaaacttattaaaataaccagttagaatctattttaggacctggaactatttttctaaatcctaccactgtattgatgtgatattcttaaaaaacaaaaaaacaaaaaaaaaaaaaacaaaaaaacctaaaagggctcttaaatttattctttgaaaacaagaaaataaaattgatcacactacagttaaataatttcaggggcttttacagagaaattctgtaaaaaaaaaaaaaaaatacatatatatatatgaaagacatcggcctcactgacaagaaaatcatgactttcctatgggacccaatgtcaatttttctagattcgcccacaagatccgaactacaaaaaggatatatgtcatcatcctatgatacaaagtaagactcaagataatatagtaaaatcctttcactaagcatgggtggtgcatatataatcatttttgctggtcaaactctcagatggtgtctgtcaatgctaggcagccagccaaaggaaagatatgaggtagagagaagactaaacttaataaccccaacaaatgcttgaggcaagtaaaaatctttattctcagagggatataacaacacacatcacccacttcccttctccatatctcagtttaataaaaggaacatgatgaatcgtctgccttattttgtcatagatattgtccaaatttaagccatgctctgaagatgggaagaaagggaagagaattcaagtaaagcataaaacaagggtatctactaaaaagtcacaacataggacagactaagatttgaatcgtgaaaatctccgtttttatcccatgagatacaaccatcagtattatagttagtgtacaaaaaaaagaaatatcaaggtataaagatggggagaaaggcattagaactttccagtcaccattatttagagaggcatccttccattactgctgtagctaatcaccattgccatctacctgaagctgccaatgctgtactttgcaaaatgcatttgtgctcaagttggttttgacaagtgaggagtatgatcttttattaaactaatgccaggtactgcacaggtcaaattactggtcaacccagaaagtctattttctaaatggaaagtagagaagctacgcatgcatatgcgtcacaacagagacatggccgatattctagaatgtgtctgccaggctcgcttgccattttcaaagactgtacattctcaggatgcattcacaacacaggccatagctcctggaatttagtagattattatttgctacacagctcaagagaagccacaaactgcgcactgatttttgcttttaagaagttagattgtttcttaaagtctaaccaatgcacagtatctttgaacctaatgggtctaatatttggatgccatatcatgtttcaagttgctaggcactctgaagacaaggtgatgagctcaatgtgcacttatagctattaaatgtaggtgagagaaccaaccaagaccagcaaactgcttttgtctgtccttaacaaactgccgtactgaggacaaaatcctccctttcgtacactatactaagtagtgctagacataaatcggggagagccattgaagtccaccagtaacatccacagatgaatgcaatttatgagaaattcctaaaggttaagtagataacttagagttgaggtatatgattggccaactgacttaaaacagattcatagaaaggatcacatgctacaaaagtgaagagacaaaatgagggtgccatttatctaatttaattctaattaataagctgtttcttgtggacatcaagaaaatatgtggcatggggaacaaaactaacagcatgtaacgaattggctttgtttcttttaactgattaacatttccttaaatacagagttttgtttttaaagggctgtttgtcataacaatgtacttaaaatttttaaaggggaaggtgaatattgctgttaaatgagacagggagagaatgttcagtgggaacatgcaggtacccctgtctttagcaatctgcttcctccttaaaaagtgcctgtagaatttatgagaagatcagctgaagtcatctctgatctttctttctctgtaagcgtcaggatgagagctctgaaggagagctcaggaacagggcctttggggtctggtgggaaatgcagtgcatagcagaagagtgaggggtggttccaagggtagtagcctggtctgaaggtttgaggggaatgagttaccatgggactttacattcccttccagccacagcacatcctattgacactttcgcaaacatggggcatccagagtttgtgtggatgataggtttttgttataattagcttcattttcactgggacaagggtagtgacagacaacctgcccaagtcaacagcacaactataccaacacatgacgaaagggagggaggtcccaaagttgatgtatcattgcttaggagggcaaaagcatggcacagataccacctggggtagcttccatagcagaggttctacatgaaccagggcctgtggggacagtgaatctgtcacatgaaatttgaacagggtcacctgttgacatctgtggtcaggatagatcttcaaaatcaaacagactttcaaaaaaattgtttatggtatttctttttaaatacagctcccaaaaccacctgttagttttaaaatttgatttaagaagcattatactttagaatggaataaagaaataactgctccttgagttccatgcactagactaaatgtttaatatatcttatatacggtgttttcaaagagtcttgcaagatgttatcattactcctattttatagatttatagaaagctttttagtaatataggtattaggaagggagggagggaaggaaggaaggaaggcaggaagaaagaaaggaaggaaggaaaatatatgaaaagacagtaaggaggagtcactgaggttatgagtgagagaacttctgatctaattgtgaacccctcatgatggcagcagcagcaggccatgtggagcggccactgccctcacactggctgcagatgggctgcctcagggacgcagggcataggggaagcggggaataggggacccaccaccaccactgctgcctctgcagccactcctgccaccactgctcgcagctctgatctcagagcagagttgaggccgagcctaggtgctgtcagcctgactgagtgtgcacatgttggggcagcactgagacaccagccccttgctgcctcagcacccccagactttaggtactgaccagggtggaagggaagccaagtggggagctgagggcaactcagggcctgcagatgccccttggcgtgagcagcctgggtgccacagttggtggcaggaggcagacaggctcctgggcagaaggggatggatccggtgaggtcccaccttcaggccagggagggcctgaagtctgagtgctgggctgtcagccccacagaccatagtgggaactggtggtgccttttctgggaccgcccatggctgtccatggaccagctggcatgcacttcatcccctctgaggcccataaaagttccaggctcagccaaagcaaagcagatgggacaaccagctgcaaaaaggcacgactctctctgttgttagctgaacacctgctgggatgaccagctgcagagaggagctaccctctctgatgagaactgaggacttgcttaacagagaggagctaccctctctgctgggaggtgaacactccggacgacctgcctaacagagaggagctaccctctctgacaggagctgaacattcatcaggacaccctgagacggagagaagatgcccactatgggtctcctctgagctttcctattgctcaataaagctcttcttcgtcttgctcatcctccacttgtctgcatacctcattcttcctggtcacaggacaagaactcaggaccagccaactggcaaggctaaaagagctgtaacacaaacagggctgaaacatgccccttgctcaccacgttgcagatgaagagaaggagagaagggctgtggccctttgaggaccccagacctgggagctccccaagccagggctgtgactcactctttggggcctagtggttcctgttgtttccaagtttccaggtgccactgcattcaccagtgccagccagggaagctgctgtggtgctcctggtccaaccgctgcctcacggagaactggcagccatactagcacccggaaccgcccaccccgtggcagcggccaacatgtctgactgtgcagtgaccaaaccccacgttcactcacacaccccttgccattccatgcctgactcgcagtctcccttgaagacatgggatccaggccggtagtgtgagctgagtgcagcctgccaggccaggtgggcagaacaagaccaacgggcctgagcaaaacttggataaaggtgccactggccacagaggtttctggccaggaaaataacaccccaaagatcttgtaacactaatattttcactgtgccaaattacaagctagaaaattataaagattgcacagataatatatcgcaatttattaaatattttgaaatatcttttatgtaactataaaatgtatactgattgtcttctcaagggattggcacgtactttgtgccatactacagcaattatttttcactagctaagtgagaaacttcacccagaatatgctgtatttaaaagttctcttaaagtgtaacatcatcccaggatccaattgaaatcagagattacgatgtctgaccaagagacaaaaatcaatgtcagaaaattcataaacaaatcacccaaattccaagtttagcatggtaggctactttggtattattttacttatacattccatttgctcatgatttaaaaagacaaatacctcaatacagttcttgacactgattaactctcttccatttcaagacacttcaatgacatatttctatgcatgtctataccattaattttatttaggcctcaactctcaattcctttagaatgagtattaaagcatttcccatttggtagatagatatctatgcctctgtatgactaccaatatctaatttttcaaagggctgataggcacactgacagacaggaacagaaaaggagagagaagaagaaagggaaggaagaaatgaagagaggaagaaaagatttaatttagtgaaaagattatctcccacttgcactttctatcaatgttaggttattatttctaactgcttgaaagattaccttccagcatctcaaaattgttgtgttgaaaacataccatgtcatttgccttcccagtccttctcctcttactgagtgttcatttctgtttttggcatattcactctcccatataccccacctaacagcctcagcctcctcttctgccttctcctttgcccacaataccaattattaagttctactgatttatcactaatatgtcttatccctcttttttgtacccaaaaacaatggccatggttcactcctaaactggacattagaatcacctgggagtcctaaaagaaaaaaaaaaaaaatgaaagctacaggtgcctgaaccccaccctaaatcaattaaaacagaaaacagtgcatgggactgggtaattaatttacagaaaattccaacatgcaaccaggattgagaattactgaatgatgccatgatatccatagcttcccatctggtcactctcacttcaggtgcttcatctcgacaatcaatattacactttactatggatccttcttttgttttcccttttcgttctttgagttttgttttctaacgcatctgtgactacagctcttttccgctcaaaaaataataaaccaactttaatagcttactcctgcaaactaacaccagaaatactgtttggcctttaagatatttcagagctgctgtcaatctattttcccaaatacatttccaccattgcccacggagaacctaaaattctctcatctcgatgcctcagtacaggctgttccctcatgtaaaatgccttctttcccacttttgaatttacagaatttacccacatttttcaattctaaattaagtccttggaagccttctttgatcttccccatctagatgaaatgtaccatcctttcgactcccctatcacgctttctgtatcttttatgaatcacaatagtctatatttcattatagttattttaagcacatgtgttttctcccctttcacattcatagaaccttgagaaaattatacatgcccctggtcatctatgaagtcttataactcccaaccatacccagcacatagtttcaatgcatacatgagcttggtaaaggctgtcccagatactatcccctaatcctggactatacacttttgagtatttaggacggataataatatcgtaaatgtgatctttgcacctctattacacgtatatttgtttatagtttggcgaattagctatggaatacaaagtctatgtgacataccttgccactgcaatacattgatatgacatagtgagagacgaatagatccatgcgaagccctaagctggcaaatgtagcacagccagattacagattcatgtgtatcatcataggactgaagtttagatgaagcataatataacgtgatgagtcttttctcttttatgaatatcattccacctcattgtcatcacagagctctcttcccctctaccaccttttgtgtttttaatttttaagtaaaatgactttactcttctaattgtacgtatttattataaattagaaaatgtacatgagttgaaaggagatattctaatggtgatcaccttgatgaataacttttaagaattttccatgcttattttacatattttttaacaagaaagaggttatatcgtaccattattttgtaaccaacgtttcatttagaatatactgtgaatatcttttatgaccacaaataaattcatcatgtttatattataaagagtaaagattacatttaaatttattgttaaacatttaggttgtttctgctatttcaatcagaaaaagacttcaaaacttttttgtaatcatatctttgcacatatatgtaattcctatatgtgaattactcctacatgtaaaattactgaattcaaaaaagtatatttttaaggcttttgatatatttaacaaattatacttttaaaataattcatatattcatagcagcaatgtgtcagaatgtccaattacctagaccactgctaaagctataacttaatactttatcattggccatatttttatccactgtccaaaataatgaattgcaaacatttggcacaatgtctacatacaaactaagcaaccagtaaatgttcgtagaccattagcacagctgaccaaccttctagctctcgcatcatacccattcctccattccagttgccaccatgggacttccctgccagttgccttcaacatctctgatctcacctgggattatttcacattccagaacagcatgcaatcccagcttctgctattcacaacacaagcacacgcattacaacaggacaatacacatgcatgaagaccataacgtgggtcagagcagaaaagtggaaatggtatgttccaatgtttgagggaaatttgtcataattcaaggtataataatacctggatcataaacacgtgttttacagcaacgaaaactgtatgatctcaccatcataactttttatttaataaacagtcatgggatattatgacaaaaacaatcacctacattctgtgtgcccgggcaataaaacttcctgaactattgatgtgcttagtaaggctggccattctgttttggtgtaagacactcaaaataaccactggtttagtgacataaatttcaagaagatggcctaagtggttttgaatcactcatagacaaaatctgtgaagtcattcttaccattccttatgccatagtcatgcattcttaatgaaaacatgttatcagcaacaccatttagacattcacttaacatcttccacattaagcctctagatttgcttactacctatttatgcattcaaaatactcagactgtgcatccgttttgttcaatagagtgataaaaggcccttatactgaaacagatgagaaagttatgcattacatacaatctcccaggctcattcagcagagatgtaggcaaatgacacaatgcttatcagcttttttcatatttcctttaagtggtaacatactcaggaagccatttaatatagacacactatttgaccaaaaagaacctctaccaatgctttagcatctttttgtagagttagttttcaaagcagattcatttacatcatccactgctaatttactcattaatcataatttatcacattagatgtgctgatcatcattaaaaataatcatttattctctattctaacctgctgcttatcatgtacctgcaaattgggtcacacaggaaaggtaactggcttatttgaaaaggaacatgagagcggataaaactgaagtgggaaagaaagagaaaaataaagaacaatgccatctttcccaattttatgttgccaaactccagaatatcctgccacttcttctatacaatatttccagtgtatcaactacatgaatttttaagaggaactagtgtgatgaactgtactagcttcactttagaaacagtagtaaaccagttccacaaagagaagatctgctggtgtcactgtatgagctgaaaggctttgagccaatatgaatttttgtaacgcttgccttccaaccaaagtgagttattaccacaacttacaaaaacatagaccatttcttttaagatagatccatcttacaggataagctgaccacaacttctcatctatcaactgcacactggttaagttggcaagatactttgggaagtgaaagtagctactatatccccaaagtagctataacacagaagggagacgtgtgtgtacacatgcagacactttcaatgagtaataaaacagatttaaaatgatgtttgattgtatttactggagaaatgtagaagtgtattataagaaatctttgtaaacaaaaaaacatttttatagatacacaattttgatacataacaaaaatgtttcatgtagcacaaaatacaatggaaagtgatttgcctgagtttttattacaaagattaattatagaatagagttttacaatacatatttcctaaggaaagtctataattaatattaacttctaaatattatgacttttaaaatattagatgattccaatgataagatgcttaaatatttggctatttaaaaatattttcttggtacgcaacattttactttaagggctatttttttaatgttttaatttgtttttttgttgagacagggttttactctgttgcctaggctggactgcagttgcataatcatggttcactgcagcctccacctcctgggctcaagccatcctcccagctcaaactcccgagcagcgaggactatgggcacatgccacaacaccatgctatttttaaaatgttttgtagagatggggtctagctatgttgctcagactggtctcaaattcctgggctcaagtgatcctccggcctcagtctcccaaagtgctgggattacaggcatgagcccacactcagcaagggcaacttattaataagaatgtggatatgtggacgggcacggtggctcacgcctgtaatcccagcactttgggaggctgaggtgggtggatcacctgaggttaggagtttgagaccagcctgaccaacatggagaaactctgtctctactaaaaatacaaaattaggcacagtggcacatgcctgtaatcccagctgctcgggaggctgaggcaggagaatcgcttgaacctgggaggcagaggttgcggtgagccgagatcgtgtcattgcactccagcctgggcaaaaagagcaaaaaactccgcctccaaaaaaaaaaaaaaaaaaagtggatacgtgatggataaacaacgggaaacataaaaggcaaagtaaaaaataaagttgacttgcctatacaccagtgtttttgcaaatgaaacagtgacttaaaaaatatactgaaaaatgcccagcattattcacatttagaccaataccctgacagagatcatattctaagtttataaggttcatgtcagttttattttgtgcaatacctaacatgttgtaggcattcaataccttttaaagtaagtataattatttttggtcctatggaaattttaggtatgtgtctatgtcccttccagatatttttcactaaatttagcattctttttttttttttaattcatttctctgcagacccaaagctctaagctgaaaagtatttggcaatgatttgcaggcttccaaatattctcattcagtatcaggtaaccattagaaccaataacattttgtaggatattaaaattcttattttctggtatacttccaattgagcacatgtagcaagaaaccaaacggtatttattttacatattaagtccatcttttctacacaaatatccaaattcttttttagagtgaagagaaagaatctatattcatatatgcaagatgattatgagaaaagcgttctgcagatgtctccccacgtttaatcttgctaaccacgatggatctctgcattttcacacagtggccccgcccattcacaaattctcctgagtgagctatttgggggtacaaaagatggaaagcatgacaactggttctatgctcgggctctgaaggcatgtacaagcaagcagtgataataatagatgataacccaaggccatgaactaactctgtccacacagagaactcaaattgatgttaatcggaacctggcacacggatagaggctagggtacgattccttggtttgtagatggaaataaacccatgaagaactttaataaaatgagttctagatggaacacagtgtaatgcagtaatgtagttcttttgctttttttccttcccagctacatctctgtaaaataactctatcaacatttccatgacagcattttaaatctgaggagaaaatgtttcattcttgccttctgtgaactgaaacacatacacactacaaatttaaaaaatcaactcaaagagggggaagggccgttttttctccctcaccgaaatctgttatgttttggccaatctttttgttacctttttccaaatggcattaaatttgtgaacatgaatatgcatttcacctctcctggtaagagaacttggataacacttggcactatagacacaaggtaacactacacgaatattcttgaaacaattttcagttggattacttttcaaatatcaagtccctaatttgtatccccaggcagtgcagaccctggtagcagctcatttcagtgccgattatgcacgcttttctagagaaacacattatctgagccccaggaatatgggaggctttccaaagaagcacagacagtaaggacctttatttgccagctaactttttcccctgtcctctaatttacagctcagggtattaggtaagaaaacaaaggattttcccacacagaaataaactttttgaaaaaccttcaaatgagattttaatgacactatttaccaatatagaatgcatgccgaaataaactgaaacacttctggtggtggatttttctttttccttttttctctttttcccctaatttaactattgcaggcaacatcatagcaatttaagttggttttgtgacaaattattaggacacttattttagaaggaaaatcaaccaataattactgccctggcacacggctattgttcacagcataaacagaagctgtggctgacagctgatgggcccagccccctgctatccttagaacacatttgcagatacccaagcctcttgccagactaagacatgctgtagcaatgcttttcatccaacagagctgcactgaccaggttatgctggctacaacagaatgacaccattttaggacctcctcccaggttggacttagctttagaagctaaaaatactgttataaatactagggattccacttgtataataacattggcctttttgcaccactctaaaatatgaatgtgtaatcccaagtacttgagtgttagatacaagatcccaagtgtttttttagtgtccacagatcatgatgataagaagaaaatgctttcttgtatttgagtaacagaagcatttgggaatgtatgccaggtcacacacatgagattctagatgaatttaatcttagagaattagaaaaggggtctgcaggttattgtgagataagcctttattccataccaaatgtaaagataaagcctctgggatctcaaaagttgagtgatacatgctgcttctttccctccatctttatataacccagtcatagtcactaatttaatgaaaggaaaggtgctttaaagctctctgtagcacctttgttcaattttactgtctgaagttttttggtaacctagacagagtaaaagctgccttttgagatggatctaaaaatgccatgaaagtagatctcctttcagggctgttgtttcagagggaaaaagacaaaagagaaatctaaagggatgggctgcagttaataattaaatatctattagttactccaattcgctacataaatggcctctgggggctgccagagcatctttccaagtcaaagtaaactacagggaaagacaaaaacagtgtttagaaattgcaaaacaacacagttatacttttacttagactggattacatacaaagcattcggtaatatagtcattatttttttaaagggtcaatataaaggttctgccatccttcactacccatcccatgttccaaacagtcaaacagctcccaccagtggtcctgaaccctttagtatatttccacacagttcctttcccttaagaatccccagtctgttctgaatggctaagctttgcctgagaaatcacaacactgtaagggctagtaccgttgcaaattcatgatctacagcctcaactatacccctctgtcatctatcaatcaacctcccacccttcactactctccagcaatcagcactgcactgacctctcacctccaagagatcgatgcttttgcctcctacatcaacagataaaataatgccatcaaacatgaacttgatggcaagtcacatcctattcactgtatacgaatttctaacttagaaaccatttttccctttatcttattcaagaccaattgcttcacttgtgctcttgatccacctcttcgccatgccctaggaaccttggtgcatcaattgtcccatctccctacataatcagcaccttcactctcttcctctttaacagctacttccccttaaaacagggcctttcactactgacattttgggtcagactattctttgttgtagagcctgtcctgtgcattgcaagagattgagcaacatccctggcttctacccaatagataacactaacatcctagctaccagttgtgacaatctaacattatcaaatgtctcctgggaaaacatcctaagttttagcaccaaaactactgactgtatctcaagaaaccacaggatggttggtcaccctagctcagatgcctccaaacatagtcaactaccccctacttggtactgctctattccatttaaatattttaatttctgcacatttcacctagcttataagtgttcatcttctctctcttctgctagactgtgagccaacaaaaggcatgatatgtagtgggtactcctccgatattacaacgctcaccaaggatcatgcttccactaaagtttatggagtaaacgacgagttcataagatttaagcatataccctgtacatatgagcatatttggttaaagccaaaatacaagaaaaagaaatacttatgaattaggcacctacttatgcttttattgacaaagctatataatcattatatatacatgtaagccagtgtaaaaaagatacatacaaagattatattccctctgtcaaattcaaactgccagaaacttaaatgtattttcaatttttcataagcattaagggttataataaagaaaaattacctaagtgaaacaaccaataattatttttggtaaaaaataaacttaatacatgactacagtaattggtttcccttcctatgtatttatttatccttggattttagtcattaggaaggcaatattgttcaagaccattaacttgccagaactgtactagcttctcaagttgaccctaatatgtgatattattagctctttttttctgttagactttccctgtagcatcttcatcaatctttctagcaagattgtttttttcataagaaaaacaatttcacatactaaaacgtaggataataggaattcattcaagattcctaaacataacttgtaaatgtaattggaattagattaacaacaagcaatcaacgattcaaaaaaattaaatagttaaaaaaataggaaagatgagaggatagtcttcacaaagtggcaatccagcctagttgataaagtactcaactctctggttatccaaaaagacatggaaggtttcctatgtaagcaggtttcacatgtgatacttctctaaggcacctaaataatcaacaaatacaacttctgctttcctcccctgcctctttggggaaatgtgttttataattgtaagtagaattcatagtttgatcgcagaaaggctgatgtgtcttgttttgtggccagaatttattgtaacttaggggttaaaaagagcaaagctgcaacaacataatttgtttttaaattcacagtggtccttcacccctgaataataaaaagcattttctggaaatagtgtgcctcattttaccaactttagatctttaacatctgaacttcaaattttaaacaacaatatgaatatgaaggtgtgtatagaaaaacataaaggagatttaaacataaagctttgaaaaagtcagtaattaatgaacaaatatatttcaatcaccagcagagcccctggaaatgccacatatatgaactttttcacaatctttctattttttatattccctagagcatgactctctcaaccattcccacttgctttttttttttttctttttttaatatctccttcacccttttcttttatattactgtatctttggcagcacttgcttattcttacttctggtctttccaaactcacccaaaccattaaatagacagtgctatccaagaaacgtgcagttgcaatcaggccatgaccttgttcgagaatcttccatggttcgctactattgcctacttagtgcagaagagaaagtcctgttcaaagaatttgctaaacctatcagacaagactttttacatctctaatttacccgagatagcatcaactctcactattcataaacaaatcagactcctagccttttatgaaaaaaacattttttaacatttttatttcaaaatactgcccaacagccccccacaactgaatcacctgttgttacttgttaaagatgcatattctctgagaccagatcctgaatcagaatggcacagtaaggcctgggaatttgtgtcacaaatgtctcctccagatgatcttttagcatactaaaattttacaacctttttgtgtatttgttaagactattccattattcaaaaatattttcactaaaacacctgcttcttgaaagctgattccactttcagagccatctcaaatgccttctcctgggtgaaatcttttctaatccccaatcgaatatcatttctaagggctctgaactcatgtatcactgtttggcctctctcatggccagaagtagatttaccttgaccttaggaagcttcagcttcaggaccctttccttgcataggtaccacacgtcacactggcatggtcaaatacattatacaatttgtaatagtgaggtatttccctcccaagcatttgaaggccactcttatttaccttcacacacagtggtgttagaaagctacaggaaattttgcagggtccagctagggaagctgaattgaaatatatttgttttggatttagcagaatatctttatatggttcacagttaaattattactggccttccggtataggaaaggtttctgggaatactccctactgctcactttattaactcatccagttccttagatgaggatgtcagtgacaaactagctgatatgtcataaattcaaagagtgttacaacctgtcactgtacaagaaaactggaacaccctgaaatcacatagctttacatcacagaaattatcacattaccaatagtaagttgtaaagatgaaagtttatgaattattaattttaagaaatataaacttaataattaccaatctgactggcgagggatggtagctcattatggttttgatttgcatttctctaatgatcagtgatgcagagcttttctttcatatgtttgttggtcacatgtatgtcttcttttgagaagtgtctgttcatgtcttttgcccacttttttttttttttttttttgagacagagtttcactcttgctgcccaggctggagtgcaatggtgcaatcttggctcactgcaacctctgcctcccgggttcaagtgattctcttgcctcagcctcctgagtagctggaattacaggcacccaccaccatacccacctaattttttgtacttttagtagagacagggtttcactatgttggccaggctggtctcgaactcctgacctcaggctattcacccaccttggccccccaaagtgctgggattacaggcgtgagccaccgtgcccggcctgcccactttttaatagtggttttttcttcttgtaaatttgtttaatttccttgtagagtctggatattagatatctgtcagatgaatacgttgaaaaaattttctcccgttctgtaggttatccgttcagtctggataatagtttcttttgctgtgctctttagtttaattagatcccattcatcaatttttgcttttgttgcaattgtttttggggtattcatcatgaaatctttgcccgtgcctatgtcctgaatggtactaaggaaagcatacattttactaagtctaagttttatatcctctgcagaaattggcacatgggttttttttaaaggcacacagtagtctctcactaaaagtctatctaactaaactgacttatttccatgatcataacaatttagatttcatttcaaattatttcttataataatgttttacatccttttgtaatactttataataaattatcaaattattttttctggatttcacaaatttatttgggcttggccaaaaatcttagcagcaaaatattgcttgtctttttaattaatgatgtacagagaatatgctttgttcttttatctctccccgaaataactgaattgagagaataatgcagaaaatgtagaagttaaactgattcttttcagcttatttggaccctaacatgttgcctaattacaatagcagtgaacacccacagataacatgtataacagattttatgggaattaaaggagctctataaaggactgatgttttcttaagcctattattatggaagtttatatgtaaatagcaatttaatttttaaaatccttactactagttgcaataaatgttcaatatttggtaaattaacaagtgctatatgagaaccactgtgagtccctctcagaactcacattgtgtcctattaaattgttctgacctttcccattaaggcaatttttcccacaaaggacatattgagagcttcaatgagcagtttttaataagttaactatcaagaaagatatttttctattagtaccagtagccaatatgtctatttttaaaaaatgatttcagtatttcctccaagaggactagattctctcatacgtatcctcagagatccacaaaataatatgaatttggccccataattagttttgcaattttgtgcagcatctagataaaagcacatttggaaaaaaaaaaaaaaaaaggtgaagacaagtcagaaattctcctttttttgtcctttttttgtatctagatggaaacactaccctagctacaaaggatgaggcggtatctatttctaccattgtagagtatttccttcaagaaggctggaatactacatttccttgatacggaatccctgatatataaaatgaccaacataaataaatacaattgcaatggatatctagacaattaactaaaatgctaatgaggctccaaaatccagctttagtgccaatttttacatagcatctcctctaatcgttcatgattatatttttgccgcaggccctttgcttccttcatccttaggaagccttgaacttattctcatccttcaacaatgtcaaaagaagtaactggaaaaaaaaaaagtgacaaaatcaagaaggacactgtgccattcctttgaagcagaacatttctgaatgagaggggcatgataattatgcctctcagatgcatatccacatttttgctagccatggtccttgaggatttggagacatttttaaaatgaatttcttcaagtgaatgctgagacactttggctgcaagaatctcaggagactgtgttggccagatggtggctaccatgccagagaagtcacaaaatgttccagctgaaaactgatttaagacaaggcaacaattccatattttatgagccaaaatattacactatcccatcaagagtcctccagattccaacctgttgttatcaccatgaccatcagtattttcaaatactactactaaataaaaaccagtcaagaggaaaggtttctaaccctctccatccaggaatatatctttgaaggtttctatcacttctaacttattttacaccatgttctgaagtaacaagctatctaaagtttaaataccagtagagtggattcccatctgtggggtcttggaccaagaagagggtacagaagtaattgattggggcaaatagaaaaggaaggaaatccttaaagcaaatatggggctgttcacagccatttcatcattttacagggatctgtttgagaataaagaaggattccaaatttaaaaattttctacctatggttttagatgtcactacaattaatatcaacgttctctaaattattagaatcattcctcttcaatgatgatatttgatctagagaaagaatattatcatggcagtgtaaaggaattattcaccaatgaagaataaatgtagagagagagagagagactggttcaaaagataatgcaatatcatacctattataagaaaaagaattgttcaaaacaacttcatccaaattggtggagacaccctctgttcctcaggtacaaaaatgtgtaacatagtcattaccacttcctaatgaattgcaaatgtgtttttcagaaattattttcccaaaaagcaaacatacccacctcagtttccccaaatattaaccacatttggttgaaatctttctgaaatatagcatgtacatgctcttgtcttacacaggcacatatcctatagaagaatcaataatctaagctaagcaataatagccatacacgtaacagggatttattttttaccatcacaaatatttaaaggttataggacttgcatgtattatttgttttccttttccgcttttgattctgtgtggctccgttcgtaacagtgctttgagggttaagcccactggtggcagatgactgggtcagatgcattcaaaaagataacacttatccaaattagttggagtcataaaaaacactgtttctcacattcctgtctcctattactgagtctgctttattggttactgatctttggctcccattttcagttatgcctccaggatcctccccagctggctcccagcccctcagtgaacttctccttttgaccctggcagactgccatgattccacctctgaaaccacaaactaaactggacttgttctttcttctgcaatgacttcacatactctgcatttggtcctgctaagccctatattgtatcaggcagagcaatcaaaaagcaaacctcaaagaagtaaggttttatatacaaggactcttgactttccacttactctttacctttttaaatttcattccttccatcaacttacaggaccttccacaacctgacagttgtcctggatagcagtaacagtgagcaatatgactccctaaaaactaaccttcatatggcatctcagacctcagaaaatcacatgagatttatcatttaactgagacacacacacacacaaacacttgcactcactctggctatgaaagagcttgtatcatttcccttttgcagatgatgaatctgaggcttattgttctcaaaatcagacatttttctggttatagaacagtcccaagttcagatattgtatctataaataccctgctctttttcatatgccagacccttacaagctgaagagacaaaaatgctctggacataaagatctacctggcctgaggacactaaaaagaatcaaaccttattataatggtcagagaaaatcctaaaggagaaatcgcctcttcatcatggtcaatacacagttcagcccaggaatatgattcactgttctaaattgcattgtcaagtattcaaaatcagtctcttatttctcattaccaattatagcagaaggttgtatttatagtgggggcatttccacatctagtatcaaggcagtactatgcctgacatatagaaaaaatgactttgtattccaaagggaaattttaatgtctaggaacaataaaagtgttagaatataaaatgtttacaaagaaataaaaagttcactttaaaagtttaacacaggtaagaatagctgtaattttacaacacttgttccttttcactaacgtttaaaaattttgtgcatgaaagcagaaaacaaaaaattgcaataccatcagcaattatattctactattactctgccatatgctgagaaaagcaagataagaatgttgatttatactttcacagttatttctgtgtttgtgttttatttctccaaccattgacacttattgagtgcttgtgacctatgcagttatagtaaagtaaaaatgaaaaatctcctcctggttaattctaaaacttcatagcattttgtacatttcactaaatattgaaagggacagctaattaagtatttggtctacaacacggatctatttatttatttatttacccattcattcattcattcactcattcattctacaggtaaagccttgctacgttgcccaggctggtcttaaacctccgggttcaagtgatcttctaccctcagcctcctgagtggctgggactccatatgcataccaccagagccaacttttttttgttttgtttttcatagagcttttcaaaacctacagaagaacaataacttatgaggatttgatgtattttacataagtgagagacaaccaagtcacaactgcatgtttaattacataaatgtatatgaagagcaccgaggttcaaactctcaaaaggaagatcaaaatcggtccctacatttgttactggggaaacggggtcactgctatgttggaaaacaaacaaacaaacaaacaaacaaacaaaggtcagactccaagaacaggatgacaagagaatgcttgaggaagaacaccaatcttgggatcaagagacaaggaagcatctctgctgctggttatgttcatggtatggtctgggtacaacagggaagagatgacatacaactatagtctatctgtagcccacacctgttgtctaattgtagacaactcttcagggctctgatacagcctaggaaaaatggaaattttcatcctctggcttttctccaacctccaaacctaaccctcacaagggtttcacttcctacttgttcatcccagtagcatagactcaccaattcaccataggccccaatactccctactgcctttccctcaaatcaggaccattttttcacttttatctggaccctgtaagcatctgaatttgtgattctcaaacttttatcccgtactaaaatggatattttttttccattttgcaaattcatttctgaaaacaactgttttaaattttggttctgtggcacacacatttacctttttatgatgattatcttaaaggaaacctctttctacatatgtatataaaagttaaatgctaagcatattatctaaagtcagtagagacacaccagggaaggaattcctggtgtctggaatatacaaataaaaaggttttgttttcatacacttggataactctaaacttctcagaataattagtctgttagcaatgataaaacctggtataaaaagtcaaatactttttattttatcaaataaaaactatttggaattgagcttttgaaactgactcttccaactggtcttttgattgaaagctaattttttaaataatatacttcttataatgaggagaatatttttcaaacatgtttgaggaatggaacacccaagaatcttgttttttttctttccaaaacgaaactagtattgagataattggctttttttttttttaattctgggtccacaaggtaaaagactcacaaggaaaaagctactattaagaaaattaaaattttggttaactttttatttaccaaactaaaaaaaaaaatatcactgtcactgaatgttaggtgggaaattttgttctgcatgtgattgtaaaagcatagctgtgattgaggattttaatagtgtatttttgttgttgttatttatttattgggaggcagtctcactctgttgcccaggctggagtgcagtggtgcgatcttggctcactgcaacctacgccttctgggttcaagtgattctcctgcctcagcctccccaagtagctggggttacaggcacctaccaccacacccggctaatttttgtattttattagagatggagttttaccatgttggtcaggctggtctccaactcctgacctcaaatgatctgcccgcctcggcctcccaaaatgttgggattacaggtgtgagccactgtgcccagcctttaatagtatatttgaaacatgatggtactatatttgcttaaatgaaatcacaaaaatgattaattaaagtgtagatattaccaattaagtcttcaaagtgcattaaaaaaaaaaaagcaagcttaaataattggcggaaaatgttttttaaatcactgtgtttcccaagacgatctctgatatttcacactgcttacagatctttccggatgtcatggaaaaatatttcctgcagtcttttcattatctctaccatgtcgagaggatattaacttttattttaaccaacatcatctggagactgaacactacaacacagtgcaaaaccaattggctcttcatcctctccaaactttcactagaaacttgaagatatgcaaacgtttacacctatcatcaaataaatccattcaagattcatatcagaatcttctcttaataagcctttaaaaaaatgaccaagcatcatattccttctcatttctcatcaccatcatgtgtatctatcaactcttctgaatcatattaaccgtgaccatcaaggttcaaaattttcttagtgaatacggacattttcctatagagaacacaagtgtgtagatgctgccaatcttttcttcaataaaggcaaattgttgtttaagcactatgggtacaaatacaaggcaagcacccatccctgatatcaaactgcacaccaagaagcatggaaaaacaagcctttatatagtactccctccaatgtgatagatcagccaagtggcatgaaagttacacctgccagtcaatctatactttcctagtgagcagagaccaccagctcatatacttccagatagctctggtgtttatggtatataatcctcttaaatgcatgtttgctgagacacagtaatgactcacattgtatatatccccacactacactattcctgcatacagccagaagctgctttaaaatatttccccagtcatattcatatacaaagataaataaatttttcagtttttcaccaagttttaaatgcaatctcttgagtcccatggttttatcacagaaaggtacacttcagcttaagaagggaagaattaaccattcaacttctaacaataacagtacactgaagacctaattcaattggcacagtctgggaaatgttcaccaactacacacaattgagtgatagaatgcaaaatacttcatgctttcttagcagaacactaaaatctatcagagaatgcaccttgattttgtcaaactacagcaataaaagtaaagcagcaaaaaaaaaatatgttcgctcattctcaaaaactgagttcgaatttttttggagggagggtgtggttctttcacaagcagtttttaatcaaaagtaagattttgtttatttgtttcaaatgtgtcaaattgctatgaaaaacagaaacaaatattaagctagccattgtgtccccacgaaaatgcagcaggtcttaatactctcccagctgttctgacaaccactgtaggcagcccttcccctctgtagacttggctgcattgcactggggagtagcatgatgtccacttgaaactgtattatctggagcttgcttttaatgtaattacttcaaaacagagaaaagaattaaaaggcagggttttttgtttttgttttccatgagctgatcctttgaacagctactgagaggaggacagcttacctgaattagaaagaaaagctcaactgttaagtcacttaccctaattaaagatcaatacagatattattagacattcattctacccatctaatccagagttgtgatgttacttttcataatacctgtatacacttactgccaaatctgttttcctgcttttcctattgtctttttctctattatttcccttcaccccacttttatttctcttcacagaaatgcccctgcatgacacatagtaacaaaagtcacagtccctttgcaagaaggaagaagcttgaatttaagcagttcttttaaaaattcaatatccaaagaaatactttactgtaacagtgtcattgctactccttagacttgttattatgtttgtgaaagttaattatctgataagatacactgtggttactactgtcacaaaaaaatgcatgggtatgtttattaattcaaagtgttccaatgaaataaagtgtgttaactaaagaactgaacaattatttccccgtaattattactgcacatttaggcgtttcataactgttttttttttttctgaatgaaaatcactttatatttaaaactatcagcatttacagctttgtattgtaaaagaatatgctattttgtccatatttttatactaaaggcccaggttgaaaaatccaacaatttaaattgaagatttttttcccctgctgtagaaaagtgtcaacatttgagcaaatcattaaacatactagaacaagaacctacaactaaaatgctgattatgattcatttcaaatattttaagtgttaagtcaacattcaatgcaggataaaatgaaatggtttgttcagaaggaatagttagagatctgcttactattctttctatttctgttattttcctgggataatccataaaaatcttatgtgaaagggaaaaaaagagaagatagtttaaaaatgaaagccataatctgaatggaattcgtatggcttcatatcagaaagcccttataggtgtcactgcctcataaaattctagcaataaaattgaagccaaatactctcctttcacagaaactacctttttctcaatatctaaaaatttgttctaagacaattggaagagaaaatacatgcactcctctagccaatagatctgcaaacttctaggtgactcatttgataacaggagacaaaattgtacaacacactaaactctattatttctacatcccagtagtttccagtataatgaatgtcctgtgagttttctgcagacatctagcagaacataactgccccctcgagtgaatgctacaccacctggattcaacaatacatatcactttggccatccatgacctccgccttctcaaactgatgtacgactaaaaacttaatattttcacactagcacaagcattgtgtcttgtgtacatacattatctctaacaagacacaagcattgtggcttgtgtatgcacattatctataacaatgttatttaatataattatacacaaaaataaagggaatttggagggccagtttgaaacaaaaccagaaggccaggcgccatggctcacgcctataatcccaacactttaggaggctgaggcgggcagatgacctgaagtcaggagttcaagaccagcctggccaacatggcgaaaccccatctctactaaaaatacaaaaattagctgggcgttgtggtgggcgcctgtaatcccagctacttgggaggctgaggcaggagtatcgcttgaacacgggacgcagaagttgcagtgagccgagatcatgccattgcactccagcctgggcaacaagagcaaaacgtcgtctctaaataaataaataaaacaaaaccagaaaattcaattttttttccatcttgtttcttaaatccaaccagttcaacatatcctcatgtactggttaagcttccctaaaccaaaaatctgaaatccaaaatgtttcaaaatccaaaactttttgagcactgacatgacaccgaaagtgaaaaattccacatctaagtacttaacagaaacttcatttcatgcacaaacttatttaaaagattgcataaaattatctctgtgcaatgcatataagacatataaaatataaatgaattttatatgaaatttcacatacatgaaatataaatgaaaggtaaatataaaatataaatgaattttgtgtttagacttgggtcccatccccaagatatctcattatgtatatgcaaatattccaaaataaaaaaataaaataaaataaaaatccaaaatctgaaacacttttggtcccgatcatttcagataagaaatactcaacctgtatcataattaccctgattctacaggcaattaatgcagtttcagtaagaaaattaagaaaatagggagtctctctgagcctattctggcttgagaagttgcccagtaaaaaataataaaaataaaataaaaactaagaagaaataaaatatacagatcactaattagaaaataaactataaatcatggggttaagttggtcacttttaattttttgcaaaagtgaagatacccaatgaccactggctaccatgttgtgctagtgtaaaaatatatcaccctggaaagaaattccagtggtaactgactcttttagcaccattttactcaatgtaagcaacaccaagaacagtgtcatgctacctaaagaggtactaggtctgaagaaagccacatgctcatttattctttgtagtaaaatctattctttatcatcataattattcttctaacctaaaagaggctttaattagatgttcaaaaaatagatcaaattaggtgaatattcaatttgcaaactcagccaaactcgacaggtttcattctaattacatgcagatagatacatggagacacatatgttcaccacagttttccatgtgcttcctctttcaggcaactgcaagattaagccaaactgtatggcaaagcgttccagaaagtaccatcttacatagaataagataatttctgatttttaatcttaactgtaatactaagagactgcatcaaaacaaagactagacgatttacttgtttaaaatgtcaattatataaagagatggtgaaattactactagaagaaaaaatgcaggccgaaaacaataaaaatagtgaaaaatatttggaaaattgcaatgtatatgcactgtgttaagtgattcataactgtctttcaattaaaactcgaatctttactataatagaattccaagagggattttcttagtctcaaaattgtgtctacaatctgaaattgagaacaaaaagtgcaaagtattccaaaagttagagatagcttgcagtgagcaagccagaagcttgtgggaacaattacataccttgagctcagaccaaaatataccagagcagatcctgctacaagtacctcccctcagcctgtccaccccttccccagctgtcacaagaagaggatcaaagaggagcactgaacagctttgtggggagttcagcggagagagagaagactcaattctctctcctctctatgggaaaggggagggaggtactccttgccccaaagtgatgaggtttcaaaatcagcactcagaagattagggatgcatgtaggcagacagtggcctcttattccttggttggatgcacacagccccactctggtactgttactagagggtagcggggtgaatttcaaggagagcttccagagagctcaggaatatggcatcttatctgttttactccccctccactatggagaaaagaagtttcttaccatgtatctcctgaaggctggggtagacctgagcagagagactggcgctcacttctgctatagagatttctgagggtataagacccaatatgcagtccataccagaaagacagacagacagtggtgaggtgtaccagggagaaggatgtgggaaatcccatccctagagtttgggttgggggctggaggaagtccctagtattttccattctcccatataaaaagacaccaaggttagtggaaggaaataggctgctgtgctatccaagtcacctcaaggagaagtcgtggaaaccccaactcatgcaaatctggaagtttcaaagagagacaaggaccttttaggatacagtaaattagaagagtaagagtagagaaataggtttgtccaagaaccaagtgagtgataatccaggaaaagtaggctggagtcacaaggtgggtcacctggaatgccagttaaaagaagtcatagaggttatgaataacgtggaggttatgaataatgtagagcctgtgaaggtttgaagctagagagtgagcagtactgtaggaaggaggagtgggaagttaatcaaatatcaagcaagaactttgcaagtccctgtgaaatgatgtcctgctttctctctcctctcctacttgtgccaaagaagttcagattgctaaagagaaagattataggggtcggtgttttctgcctctttttttttttttaattcatcaagtaagacaagtgagtaaattatcaaaaatcactcagctcactaacagagggacagttcactctttgaacccatggttttcttctctaaccccttgacttgggcaggaggaaaaggcatcagaaaaagatctacttatttaacgaaaatccctaataagacacaactgtattaactttaggcattatgtggtacattagatatttagacttgttcgtcctatatatctgctattttgtatcctcttgacctatatctcccatttcctttccctcccctgacctgtagtaaccactgtttcattctgtatctctgtgtattacatccattacacagagaatgaaacagtggttactatagctatatcagcttgaatgtatggattatagtctacatgtaagtgagatcatgcaatattttgctttctgtgtctggctaataagtagattttacctgcttttgtcagctaaaatatgtgagatgacagatgttaatctgcttcacaacagtaaccactatgctatctatatgtttctatatatctataagtatcccatactttcgcgttctaaactttaaatatgcataataaaatttgttttttaaaaatctattcagttgacagaaatggatgtcatttacagtgttccaaaagaaaggatgacaaaaagagattcagtgccccaatagcaagaagacaataggtcacctgccaaagcactgaagaactaagactaggggtgtggatgaccactgggtatgtgaaatgctacagagaggcgacagagaatgagacccagtaaaagcacatttctttcagtagttagagaggatcactggtacatttgagagagcagctgagtttttccggaggaagacagattgaagggaagtaggtggtgaagaattaaggcaaaaatttcttgaaagtgtgaggacaaacacagcctgtgtgtgtggatgtggaggtggggggaggatgtttccttcacttaatactgtggcaatagagacattcttgtatattccatttctacctatacagtgtgcttggagagtatcagcttgaaaaaggaaagtgaagaatacaattaaacaaaataaagacaaaatagaaaataaatgtattctaaacgaataacccaaaatttgaacaacttaattttgcagaaaaatgatgcgatacttctcatttaattttttaaaaatatatgcaaggtatcatccctaaactaatattcactaaatgaatttaaaatacaactaaagtaaaatgagagtggaaggcatataaattagtaagtcttgaaaaggtgttttggaaaaggggaaaagtaacaatggtaggaaatatgtatcatgtaaattaaaagaagcaaaagggaatgaaagttcgcccaggatacagaacatattaaagatacttttaaagcttattgctgtaagtatacttttaaaacttattgctagaattttcctgaatccattttctaaactgtaaagcagtttagaaaaaaaagtccactttttaaaaatgtacctagccaaatattttatctgtaggaatcagagaaatgcctacactgaatacggaaatacattcacttccagtaacctaaaagggcacatttaaagaggcatagacctaaaaagaaatctccagaaattattttttacacacctattgcttgaagagactgctgcatcaaaagctgcaacttacgacttttagaaaacacgccgcgtgcctttcttgtggttccatatgaaagaactgtatctagaaaggaccctatttttatactttgcactatttgtcctgaatcctttgaaaactctcttggacaatttcaaagatattggagtaactaaatgttggaaaagatacattctttacatacatactcaaatattcatcaggaaaggtaaacatctcacgagtccataaacattcatgggtacaaaatgttttcattcacaagttttcattcaaactaaattaccagttaaggctattatctcctcatacatgtgttaaattatctatttgtgttgtaccatctttttggttgtttactgttcatgttcatgacaatttgaagtcaatctaacactaataaaacctttgatgtaaccttcttggtttaagttacctctagatcttcttaaatccatttcttcgctgagacgtgaaaataattttattagtacagaagctctctaattaaacagaatgagattcaagtagtttatgcaaatgggttttcatcatatgataccaaatgcaaattaaagggaaaagtcacctgagacagacattaattttccccaaaagaatttgacactacacatatctacaaaacatattgactaaaattttcatttcagaccttcaactttgtctaaatgtaatctttcgtgctttattagggttgggcaggatgttacagatattaatagtgacatgctagggttccttgtaacacacatttaactctaccttcttataattactcattaatttgctatttcacttcttaaaaatattaaaaagggtgtaaagttagaaattgaatatcctctaatgaacaaatctccagttattaaatactcttaggaaagcaccacttcacaaatagatgatgtcacatactgtccctgaaatagtattcctttcagatgaacagataaaaatggcaactgattatgaaatttttagttaaggacctaaatataatgtccctagttagcaaggaacatgtaacataccttcattttccaacatcttaatttttgtactctgtgtggggggggtgggtgggtatgtgggggtgtatttttagaggcctaaatcctctcaatctttctgtttcaattctgccaattaaaaacagtagacacagcaaataaatgtaactggaaaatttatatggaaaagaatcagaaacctcctatccatttcctatattaaaatgagcttatcaaacctgcaaaacttaggtatttcataaaacacttgattttttttctactaagatatccttacacatcttaccatagatatttcaagctaatttgtattagctgatttttttttttctctgagaatatcagatcatctctcaaagtatttttctctatgaaacacagcggctgtctccatttaaaggaaaacacacacatacgcacagctaaaggttaactgaaacgtaagtagaaattgcacaaaacaaaatttgaagcaagttatgacctctttctcatgttgtcacctattttccccatcctaagcttgagttggctccatctgcctaattataagcttaaaaccctctgggtggtgactgagtctatattctgcactgcacttaacacatttttcatgctctataaattattaataataacagtagtaatagcatatacttttcctactataaaagaaaatatgaacctcacaactgccacttatttacactctcttaagccttccagataacagacagctgggtaatggttactaagatgactttgcctcttccttctattccatttttaattctccttaatgtatctcatttatgtttttctctttctatatttttaatttatccctctaatttcttgacctcgtatatttattctcttattctgaatgcaaagcagcaccagtattttttaatttagctgctaaggaaaatatctctatttgtgtatgttcaattggcataacgagtgcactgaagtagtgtttctcaactttggtgctattgacattgggggctgcatgatttgttataagtgctattgacattggggctgtcctgtgccttgcaggatgttcagcagcacccctgacacccacccagtacatgccagtagcacatcctgccccctattctgacaaccaaaaacgtctccaaacgttaccaaatattccctgggaaacaacttccccaccaggtggagacccactgcaatatggtaaaactattcccttcactgtgtcacattgctggagctaagacggaataaagatgtgataaatatgaaatgggaataacaaaaaatcacatagacacacacacacatatacgcatccaaaattattttgaatgtgcaattcaagcatttaaaaagcctgaagtttggctcatgcctgtaatcccggcactttgcgaggccgaggcaggcagatcacaaagtcaagagcttgagaccatcctggccaacatggtgaaaccccgtctctactaaaaacacaaaaattagctgggcgtggtggcacacgcctgtagtcccaggcactcaggagactgaggcaggagaattgcttgaacccaggaggcggaggttgcagtgagccgggatcgcgccactgcactccagcctggtggcagagcaagacgctgtctcaaaaaaaaaaaaaaaaaaaaaaaaaaagcatgaagttaatacaagcaaaaataagtaaaattccaatactaaggattatttgatggctaaaaaattagttctgctactttacttatgaaagctaacctggaagagctctaagtaaggcactagctgtgatttaagaccagtatgttttaacatccaattaaaataaatccttctaacagcacttttataaaatcacttagcttgttaaaacatataaaatgtttggctcccctgggctagattatgattaaggtacattcagagaggaaaaaaatgcttctcatttcacaaggtcacagtccatttccaaatgagcttatacttcactattttccaaattgggttgttttttgtatgtgttttttgtttgtttggggtttttttgcttccttcactaaactagccaaggtcctcctacttctgagcattactgtaaatctagatactgtcaaatagcatttaatctccaatgaattttaaaagccttgtaaattacaaaagaaataaccagggtatatttttttttccttttaagttttctctcctgtggtcagtaaatacatgtcaacatccaccttctttattttaagcaccaatgcagatagcattaagtggatgtcgcatacacttgggacatatgggaagcctcatgagataatgtttacatgcttgagatccgcagttgattccacccgggtttgaaatctggctcccaacctttctcccctatgtgtctttgaggatgttgccctctctaagcctctagttcctcaagtgtgaggggtggaaatttttgtacctattttatggaattgctatgaaatggaaatacaaaggttttatcacatatcctgcagagtgagctgtataataaatgttgactattacagattcattaatcaatagatgagcttcaacgtaagtattgtctcacgcaaaaaccccactcctccccctcctaaatctatgtaatcctgtatttctttatgtcatacccccacctccaggtacacactacacacatatgcacacatacacacacacacacacacaaaaaaaaaaaaaaaaaaaaaaaaacctcacgcctggcaatcctattccctccatcacactcaatacctcaagttcctatccaagacatgatgaagccctgtgcctccttcaacatcatcaaaacattccagttactaagcttgtggacccatcatctcacgtcgccttcaacatcttagacagatcttatctccatcaccttgtctccacccctgccgtccccactctgattcagtctcttgccttctacaaccagggcaattttagaagcattccaacttatctatatttacagtagcatccctactctgatacactcttcatagtgaagtcagagtatgttttctaaagaacatatcccatcattacttccctctgtgacatactgcaatgtgctcctggtccctgaccttcgggatcaactccaaccctcagaatctaacaggtaagtctatttatgacctgagccccgtcgttctatcccattttgaccaatagtgagtgcctttcatacaaacctatacaataaccacagcaaactatctccaggtccctgaataagtgacattactcctaatacttttttgtatattaagactgttgcctggcatgtaaatctccatgcatttgtttgcctagctcactttctagacctcctttaagcatcaccttcttcatgaagcagtttcagaaccctctgaggctgagagatgctccttcatctgaattcccttcttacaactccctaagcccaccttaaggagcttaccctccattatagtagctttctcatctatcacacccaccaaaattcacagccaaacattagctcattttcatttttttttttttttttttttttagatggagttttgctgtgttgtccaggctgtggtgcagtggtgtgatctcggctcactacaacctccgccgcccaggttcaagcaattctcatgccccagcctcctgagtagctgggattacaggtgcctgccaccacatccacttgatttttgtgtgggtttctttttttgttttgattgtttgttttttgatggagtttcactcttgttgcccaggctggagtgcaatggcgcgatctcggctcaccgccaccactgcctcctgggttcaagcaattctcctgcctcagcctcccgagtagctgggattacaggcatgcgccaccatgcccagctaatttttgtatttttagtagagacagggtttctccattttggtcaagctggtctcgaactcctgacctcaggtgatccacccgccttggcctcccaaagggctgggactgcaggcgtgagccaccgtgcccggcccattgtcatctatattttgttgttgttaaaaaaacggagtgcttggcacacagtaggcacccaaaataagtctgtaaaaaagaatgcctgaatgaaatgaacgaataaagtgaatattaaggaaattaatcgtttcatttagttataaaaagccataatggacaaagacataatcaaacggcatttttaaatggcttgcatacctaagatagccataaaggatgttgcactttaataaaaaattaaagatctgaaacacagaactgattttcaggttccacttaataatttctaaactggaaatctcaacaatcaaaacatgggagccgtaaggatgcatgcacacatacatttatcacagcattattcacaatagcaaagacacggaatcaacctaaatgttcatcaacagtagacaggataaatacactgtggtatatatacatgaggaaatactacccagctatgaaaaagaatgagataatgtcctttgcagtaacacagatggagtgggaggccattatcccaagtgaactaacacgcaggaatggaaaaccaaacacctcaagttctcacttataaacgggagctaaacattgagtacacacaaacacaaagaaggaaacaagagacaacagggcctaattgagggtggagggtgaggagggtgaggatcaaacaactaccaatcaggtattatctgagtgatgaaataataagtacaccaaactcccgtggcacacaatttatctatatagaaccaatctgcacatgtacccctgaaactaaaataaaagttttaaaaaatgtgatagccagattattatcagaaaccagcaaggcataaagtggaacatcaagtaccactttaatagcaaaatgtctgatttccccatgacaatctgtagtactccctaaattattaacagacccaggcaccacaagcagcggggactcacttgggaagcgagcaacacatttatttagttctaagattgatgaatcagaggaaggggaaagcagcagcagttattttgatctgtggggggtcttggtgccttttgtatctcagcctctgctggtgttgaggctctttgtgggtgcaggcctgcaggctgcttgtgtctctctctcctgctatctctgctgacagcttctctgtgtgacagcttggaatcccggcagtgaagtgtgaaaataaaacacaggcaaaactttacatgggaatttaaaattggagttatatttttgaaagttttgaacgcattaaacatccagaaaactgcttccttgttagagcgcacagggaaggaggagtgaacaaggtcaaatccaattcagacatcatttcacacgaggctccacaccaccctcactgtccttacgaccccgggagtcctagattaaatgttctgagtcaagttaatgtcaactatttgaccttttcaaaaccacggttttccaaaagttaacatctaccacatcacacttatgttccttctgttacatggtttgctcttttaatagaagttttaaaaaaactttgtcataatctaaggagatgagagaatctatactctcttgtctcttcttgattcagtcttctctcccccagcccccttcactttcagggcattccagaattcaagtttaacgagggcaaaagacagtcctgccaaagtcaacaatcaatacttctcaataataaaggaaatacagtattttggcccatatttgctttctataggataagattccaaaagcgaagaggaggataattatcaactccaattccccaaaacctttgtagtataaatgtttctgaaaggcactgtgttttgcaatggtttgatagaacaaactcccttatgtataaaatgacatatttttggccacagatacataaaaacacagaacacatttatatccagtctaataacataaaattgatggcatggtttggaacctattctctggattaaaagtagggtccagtagtagaaagggtgatttaaacaacctaaaataaaatgctttggtaaagaataaaatgtttcatgcaaatatgcattaataatactgtgccaataatatcgagagcagttcatgtcacaatgcaaatcagaaaaacaatctcaggaatttctgagttaaacagatgaccctgttcgaagtacatagagggttgggatggaaaccgataagaaatggaaggtggtagtacaggaatagcaaccattagcctcaacagcctataaaaaggattccatctttagaggcagaaactagtcgcttcctactgaatttctggaatcctaaaatgatgcattctcatctagcatcatcccacaacttcaaagcagtttgttcattatcatgcaatttcagcaaatcacatcctcttgatacgatttctgatctggaaattcagatatttaaataactgttctccaaattcctatttctaaaactgcttcaaaattcctaaactttcccacagttatgagaaaaatgtgtgatccttgatggtcatcacttcatattcactgtgattatctttgctctctcagagaatgatgtcagcaaaagtttcctttcaccacttgcgggtatctatgaaactacaattttacacaggatgcactgtcagacagcatagaacgccttcaactcctgaggcaatgttgctttcaaattgctaaattatcttttaaaagattcaccaattatgttgcaggaaaaacacatgtggtttagaatataaatatttacaacagatactgagattcagaggtgaaagaatgaatagtgatgtgatgttttctcccaagagacatttgccatgactgagaccactgccaaagaaagctttgttctccattccctctgtgttcctgcctgctgagctcttcttccactagtcattacaactacttctttggatagcttatgactgttgagcaaatatggcatttgtgccttacaaagctttcaatttaacaaaaatttctcaaatgcacaaatgtactaattctaattaccaatatcttatatttcacactgcatgtctactagagaaaagatcaattggccagaaagcaaattaatctcattaaaatccttaatgtaatccagtacagtaacaaggagattaaatgtaatattgaaacatttcttataaatcatattttatatattagatactatgattcttttgtttctactgcataattacacatatatcattttgaataatttatattatctatttaaaatctatttaattaatcaagagaaataaaggaaagaatgaaattgaaaagaaaaatttatctaaaagccgtatgtaagaagcaaaagcgctaacactggaaaaccaatgttgaaaagaacccacagttttcaatgataccacctgttcctccttgaaagctaattaaaatacaccttaggaaacataattgcctacagctttaattacatctcttccaagaataaagggctaccactcccaggatatgttttctcactcagctactggtgtgtcttctctcgtgttgaatctctttctgacatcataagtgactgcccacctttccatatatgtgcaatcatgagattcaaagcctgtatcatttcagaacctagtaaattcaatagcaattttatatttatacctatctctacattgagtatatatacacacaaacataatgtacgtacatctatatactatatatgatattaaatatacacacacagctacaattatactacctagcaaaatacagatactatataaatacataaacacacatacacacataaatacatacaaatatgcctatacttctatatctatgtctttccattaccagaacaaattatgatatgcatctgttggcaaatacattgtttgacattcagaactaattttccactggaaacaatgtcccagactagcccatggcaggcttacaaatccaacatgtagtcgaatgattggcctcacgggactgatttgagtttcagggccctggaagaagatatgctgtgaaagcagcagcaacacaatggaggataggaaagggaagaggagaaagaacacattttcctatatttcctaggttcaaaaatttgaaacagtcactttttggtattcctcctctcccttccttcacctatctcctgactttgttagtgccctcaagtgtcctccacattctgcctgtggccctctaccaaggttacgtcattcccaatcacgcctcatgccaacacatccacagcttccctgatcaatcatccatagacgcagacactcagtgtagatgaactcttttagatgttagaaatcagtttttagttaatggtaaagtccgtataaccaaagcaaacacattttatttacatgtttgtttcttaaagaacatgcttactaatgcaaataagaaactgagagaactatagctagcgaagaaaaaaaaagaaagaaaaagagagggcatagatgcagtgggttacagttttacatattttggaacaggctagtttgaagcaacagtttaaccaagaagctgctagaacttgagataattctgttattcccagccttctctttttccactgagagaagcaccatgtctttaaaagcttttgtccctcaatctgtacctcctccccatctccatacacacacgtatctagactgcttaggagaagcttctccaaccaagatcaggttagcagcagaagaaagtggtggtgcaaagccgccagccctgaacgatgtgcatgcgtcatatagacaagttgcttttgtagagataccccactgcaaacattcttttaaagatgacctgaaaattcccatccttgaatataaattcatttctccactgtcattattgtttctagcaaactacttaatataaaaagcaactacagcaataagaattcagtgattgcccttccccacttaaaatacataatatctactgttttcattattacattcttggaaaccagtacattacttcagctctaaaaggtgctgaacaaccgactacggtaggagaagacaatggaaatctccaaaaagttctacaaacatttcccacaaaacatgcaaggattttttttaaacccttaaatatgaaaaatcacttcatagcccacatttatgaacatatgtacgtaaaaaattcaatgagacagcaaaatagcgatatagacacctttgtcattcagtacaagctaaccacacaatgtgcagaatgtatgtgactcatcaaaacataataaaaatgcattatgcattaggtaaacaacaaatagtgtttttgcacgagagaagtctaaataagaatgtaaatttatttattaaacctcttcaatgagacttcgactcctaccgggatatacccattcttagcatgacaaacaaaaactaacaacaggagttcccagggaggaagcctgaacttgggctttaaataattaacacctttcaaagaaaacataaatgtttggggggatacatatccaaattacaccaatatcacacgtacccccaaaatatgtactatgtcaataagaaataaattaaaaacccctgtggtacacaacatatacatttttgcaattaaaaagaaaactatatgaaattataaaaaacatttaaaaataattaacacccttttttcccttaatttatgcctatggcaatttgttgttagcagttaagccaaaatgttatcctagtgtagcaggtgatgtacaaagctctttcttaaaacattgaacagaacatcacatttaaggaaaattaaggaggctgaaatgggggaggtctgagtatattttcattaaatatcaaagatttagtaatactaattacatgttttcttcccactcagttaagtgtataaaacagatattcactattttagctcttctaatgtaggcctatcataggtttttgctgttcctttctgagttgttgtttatttttttgtaagcgagtttctgctgttgctattttgttttcagtatttgtttcaagcattcaagactatgacttgcaggtttcccaaaaaaagtgtctaaaggcttttaaacctgggttctagagagatgagttttaacaataactccaacagttaccttaatcactgccttaataggtccacatgattttccacatcttaacttttgtaagaggaatataaaaaaagagcagcaggcttggaagaaaaggtggatctggcttaagaaggcataccacttttgagtgccacacacaaagctgtattttctgcatgtgctgtggtgtctctctgaaggaattctcttcaaatctgactttgcattcatgatttgactgtcaggtttgaaagcaaaatttatgaaaacatagggagaatataagaccctaaaagttaagcttctttgaaaaatgttaattcataacttggataagcctctctctttcatggagacactcctttctcaaaaaaaaaaaaaaaagtgtatacataagtgagagagagagaaaaggaaattacagaggacatcagttgtttgcaaacagttcacttttttcaggctggttttaataagcctccaattcagctccaacctgactctcagaacccacctcctctatatgtcatcaaggaaaaggaggaagaaataaaatttaaaagtccttcttgccagtcctatggcaggtcatattttccaaagatgcacatatctcacgccataaggtctccttccactagcagtggggagtctattccctccatttgaatctgggcacagggttgtgacagcactggccatagagtatgctggaagtgatgctatgtgagttcccagctaagtcgcaaggagacacggcttctgccgactctccttctggcagtcttcattctgccttcttcccttttcttccccgaccagaaccaggagtcctgggctaagacgtaagggttccaactactccgaagctgccatgctagagagaactcatcaggagaccaaatacagacagaaagggaggtgtctgaggagtcctaactgtaccagcagcgaatgttcaagaggtcccaacatcaaccagtgggcttgtgagtaggtaaggtcagaagactccagctacccacccctccttagagtcttctcattgcagctaagatatggtggagcagcgaaaagtcatctctgctgcgccctatctgaattactaacctatagaaatctgtgatagtaacagatgtctttttataagctaccaacgttttgtgtcatgtattatacacatacagaagctgaaacactcccaatgtgattgccagcaaacccaattctctgcaaaataaaaacaagtattatgtcccaagaactatattttgtatatcatcacttctcctcacaatgattttgtaagccatctctattttacaaatgagcaatactgggctgggagaagctaataaggtgctcaatgtcacacagctgacaagtgaaccaagattggaacccaagtccctctgactgcaaaccccatgatactcctctttccttcaatgatatccctctttctttcccctacaagttcacactgcagaggaaatcatgtgactaaggtctcagttatagtactgggctcagtaaaactagcctcactcatttcttcctttccaactaacctacactgaatcctatcatttacagactaatacacaaattatagtaatttctatatatgttgaaaaataataaaagaatgagggagctatgttaagattgattaacaggaaactatttacaagaagacacctatttagaacaatattaagggtgcctgctgtgttttgattttaagggttacagattgcactttgacaaaagtgcttctacgaattataattatattcatttacttcccaatgaatattttcattcaaaggattttactgctctctgtgggcatatgattaatatgcatgtgctcaaacaatattcacaaacttcacaatcctagagagagaaaaaacagtgatcagctttccccagtccgagtaaattgctttgagtgaatttctgcacctgtaaagatgctcttctggggatgggctgtgtttgcatccggggctggatgtcaagatgcccttctgtcctgatatttttcaagggcaacagcattacattgttattccaatggacagagctcataaaaagacatccttatattctggagcctttaggagaaagcttttctttggcagtgaatgaaaacaaaggcaaaagatgaaaggaaccatctttcaaaggaaacaaaaaggcctctacaaagaagtgcataaatgtagaaagcagaaaaaaaaaaaaggtacattatatttggcgtgagagtagagacaaagcaaggcccaatggagcaatactctttctttacaaatactgtcagaattttggggaaaaaaaaatcatttttgaaggttccaggaacaaaaccaacagacgagagcttaaaatatacacagccacaatgtttccattttgttggagtttcagaagaactcctgtgggcaaacgctgcatgtaaaacagactgggtgtgatgtaactatatcaaggcaacaaacacatcaggaacagttggaaaccagccaatactttggttttatataatgtccatcaactggttgggctgattttttaccataaatggcctgttttaaaactgactgaacagtggacttgaataaatagtgtaccaaactaacaccatagagaaatatacagaatcaaaggtgttcaagaatgtcaagcaacagcacagccacagaagaggtacaggccgatattaataaaccaaatctaatcacattttcattttccgactgaaatctttcccaaagcagtacctttacatacagtgctttttgttaaaaataaataaataaaaataaaatgccaaacgagcactaggctcctctttattatgtctttaaaaataaaagactcaagccagattggacagttttctttgaaattctagtttcagctgctttcagcggctcattttgagaaacatctgtccagtctggctcttggggagatgttcaaagacaagtgttctcatctgaatgctaagggactctcctaagggagtcaacagtcctctgaaagcaagcagaaactatcaaaacatctataacccttgaacttctttatcaagttcagtgcacagcgtacaatatgactcaatttcatctttagtaaaaaataaagtttgtctgcttcactgccacctttaagacatcatgttgttttcatattaaaaacttaaaatattcagtgaccaattaatttggaggcaaaattggccaagtataaagttatgcaggggagaattcagatttgaacacagctaacttggaatctgagttcatgtacaacatatgtatatacaaacccacatgttgcatttgtgaatgtaggcacagagtgaaaattctccatgtttaggtccacaacacagagccatgtcacgaagaattaacacatgttctaattctcaccagaagtgatccaaataggttaatgaacacctcctacatttcagatataataatatacattgtcacaacaatttcataaagtaggtaatagctccattttagaaataagtgaaggggggtcaaacaagccaaaaatgtgtccatgttcacatagttgcaactggcaaagctaggatcggaaccagagttattttgactaagaggtccagaaacttggctctaccaagccaccatccaagtagaaggttaccaaataccaaaatgaggaaatggtaaaatattatccatgagtcactgaaactacataataaaaaggaagccaaaataagttttgacgcatttaaagctaactctctaaggcatgggttaaaagttgaaagctagctatcagaagtttaattttatattctctcaagtaagagaaccaaacaaaagtagatcaaccagaccaaacttttaaaacactttaacttctctatgaagctaatgtgtaagatatggtatttcccccgggggagaagagcctgtgtaacattgcttttcactctcatgattgaaagaaaaatcaattaaaattatcctgggagacctttcataccattccaaagagccaagaaaatgctggatacattctgaatgcagcaaacactagactctcctaaaaaatattccacatatattgtttgctaaatcaaattcagtccttagattttacaggtttaagagaatctctggaatacatggcagaaatcagaaaaaaaaacaagcttatcctacatttggtttcaaagcgctttctttcaagatctcccaatttttctatgttaaaatttgtgatggcttctctcaaaactctgccagaaatttatgaggaatgaaaaaactcttctaacagattcagaaataaaactatggcattttcaaaggaaaaccaatatgaatgccttttaaataaagtttggtaaggacaacacaaaccgtatgttccaggtatgtgatgtgaaccacatggtctgtgaggcttcttgcacttgatatgctcctcctaaggtgccaacatcaacaaacaacaatgtgtactgtgactgaagttacagccaaggtcggatggaagtgtgggctctgttagccttgatctaattttttaatgtcaagcaagaaaactgacattttggggtacaatattgctatccaaagcaaatatgtggaatggaaaaaaggcaaatattaaattctgaagtaaacaaaataagaggtccttaggtaaaataagagtttttttttttttctcaactagtctccttttctcagagtaagtttcacattttatatactactcatattccctgagaactttacgtacatcagtgtctacatttggagatgatgaggttatttgatttaaaattgagaggccttggttcaaatctttgtctttgataatctatatgtataatgtcccaaataatcagaaaaataaacaattgagttatatcacttttacagttttttgaaattctgaatgcctacaaaattattctttattacaataaaaagttcgctatataatgacaatatgagagttatgtggcttaaaacaatttttatttgcataaatagtcatcctagtccacttacttggcgagtgatcagtaatttacaatgctgaataaatgtatcgttttcataagggacagatgtatttttatttttccttcttatccttctcatttcccttatcccattattctttcagtacataagatcaaatgatgaatacactgagttatccagatgtggttcaaaaaggaaaaatatagccaggcgtggtggctgacgcctgtaatcccagcgctttgggaggccaaggcgggcggatcacaagttcaggagatcgagactatcctagctaacatggtgaaaccccgtctctactaaaaataccaaaattagccgggcgtggtggtgggcgcctgtagtcccagctactcaggaggctgagggaggagaatggcatgaacccaggaggcagagcttgcagtgagccgagatcgcaccactgcgctccagcctgggcgatagagcgagactctgtctcaaaaaaaaaaaaaaagaaaaaaatatatataagatggtatctggatagcaataagttataaaaaaagaaagttatgtaagaagaaaaacatttagtaaacacgtattcttcaggtttcttattcataacacacaggccataataacccttgcaatggatacattctttttgtagaacaccaagctatccatccatagtcaaatgaggttataggagatttaccaaaaaatatacatcaaactacattcagtctcaattttctcatccatgaaaaacgaatggttttatccaaataatctctaaagtcccttgcaggcctatgactttatcactctaaacatctatgcctgtattcatatcattagtaccatcaacacacatgaatgcatttgaagaatgttctaaattttataaatcagggcatgagaaactaatacaggggcaaaaaagaggctcttcaaaattatggattagaagcaggatggattcattaatgtttttaatttcactcctcctgagaaatggagatgtctaaatcaggctgggcaatcactaaagtgactctgagaatcatccttacaaaaaaactttcttgttaaaatacagcaatatgattccacctctaattgataccaatatcattattaaaaaataaaaataaaaaataaactgtgtggatagaaagatgaaaacaaaatcagagtaagagtatatgactacagagaagggaatattttccctctgtactaattagttcatttcttgctacctgaagacttactgggttaatctgtggcaccacagtgtagtagtgtttttacactgctgatgaagacacacccaagactgggaagaaaaagaggtttaactggacttataattccacatggctgggaaggcctcagaatcatggtaggaggtgaaatgcacttcttacatggtggcggtaaaagaaaataaggaagaggcaaaagtgggaatccctgataataccgtcagatctcgtaatacgtattcactaccatgagaatagtatggggaaaccacccccatgattcaaattatctcccattgggtccctccctcacacatgggaattataggagtacaattcaagatgagatttgggtggggacacagccaaaccatatcacacaggatgtaatatcctatttggttcatctcttctttagaatattactgtttttctacactttgagtgaagagggaatacttatttggatagaatatttaaaatttgggccaggcacagtggttcatgcctgtaatcccagcactttggaaggcaaaggcttgtggatcaactgaggttaggagttcaagaccagcctagccaacatgatgaaactcccatctctactaaaaataaaaaattagctgggcacagtggcatgtgcctgtagtcccagctactcaggatgctgaggcaggagaattgcttaagcccaggagggggaggttgcagtaagccaagattgtaccactacacttcagcctaggagttacagcgagactccatcttaaaaaaaaaaaaaaaagaaaaattaaaaaaattcctctcctaacaattctaactccttctgcaacaaagtcacaaaggtaggatattttttcacatatatgactttacataattttcttctttaaaatatttagatttggccgggtgcggaggcttgtgtctgcagtcccagcactttgggaggtcgaggcgggcagatcacaaggtcaggacatggagaccatcctggataacgcagtgaaaagctgtctctactaaaaatataaaaaattagccgggcatggtggtgggtgcctgtagtcccagctacttgggaggctgaggcaggagaacggcatgaaccaccaggagggagagcttgcactgagccaagattgcaccactgcactccagtctgggcgacagagcaagactccgtctcaaaaaaaaaaaaaaaattagatttaatcatatggtcagtaatttatccataggggctaattttattcaagagaacacaatatgtttctcataaaatggagcaaaatgcccaaaacgatgttaaaattaagaaagaagatagtaggtaactgacagaggggggagaatgaaaaacaaaaaatgtagagaaaagacataaaaaatattaatttcacaatagtgaaatctactcttagtgaaaactaagaaaactcttttagcaacttaaaaatatacaggacattacttaatttcaattttcaaaatatgccaaaggactttgaatattcaagtacctagacctcccttttaacagacaattttaatcttgaatattaagcagacttaataattaagtggaaaaatggatttgactggggcatttctgtcttttcctccatcaagggaggtattagtaaatttcacaaaagtaagcctctgagaacatgtgaaagaaaaaattatctttctctcctaagagttcagaatggaaaacaatttgtaaactaagaatgagaagaaaggagttcaaaaaaataatgaaatggcttttgacaaaactattcctcgtggccacatccccgaatattccccatggccactgttctaaaatatgtactaactcatttgattcgagaaggacctaagggagaagagaaaaaaaaagaaatgacattttgattaaagaggtcgtttatccaaacatatgcgtatccactattggtttcttcctctccatcctactgtgctgcctccaagggaaacaatttctgaggagagtgtctacagtaccatgttcagaaggattctgaggctgttcttctctagagaaaaaaaaaaaaaaatagaagagtgctattatcaaatagtaatgtctgttttgaacaagggataaagagagtagcagcaacatacaaaggagaaaaaaaaaatgaacaaacctctcctggttggtcagaatctctataaatcttgaaatttcacaagtcttttgaaaccttcattacataagaattctattggatttgaaggtgatttgcctgaatatacttattggtacaaacagcattctgaattatcctttgaggttgtaaaatagtaaccagattccaagaggccaaacaatttttacctcagtacttgccagctttcttaaaatacgttggttatgacttcctttcacattttcaatgtgatgtgatcaaatcctcctgtaatctaaactaactttataccaaaagcaactttatgcaactttattttattccttcatattagtcccatctcacaccaagtatatactggcttgcatttcaacaacaaaagtcttgaaatagtgccattcaactcataatcatgttggtttttccttcatacctcctatttctatcattctattgcatactcactgggttcagaactgagggcatctacttcctggatttttactattctccctttggaaaattccgactctgatggtctctaaaattccttcttctctttttgatcatatttccttcttcagactctcaaacagctttgcattaatttataaataaaagattttcacttacatagattagtaataaaaaataatgaaaataaactaagtaaagagccagcaggtggattagagaaggctgactgctgttataaacagtctaccatctcagtagctgaacacaataacattaattgtttcattcatgtcacaatttaatgtgaattgtacggaggctttgctccatgtagacttaaagactcagtttcttccatctagtggttctatcatctcttcctggaatcttccattggacctcctgtcttcagaagccacctccattcttaaaacagcttagcctagaggtggcaccactcacttccacatcatttccaatcacatcccattaaccattgcctcatctttcctagctgagaatttgatttaatgatgtgctcttgaaaataaagaacgtattagtgaacactagcaatctctaccataggaaagctactttgatttccaagaaaatggcatattgaaattagccctatctgtctcaaaaagctgtcatgaaaatcaagtaagtcaggaacgtgaaatacttttaaaattgttaagtgctgtgtaatgatatggcacactgacctacgcctccttttgataccttcacttctatacttccacaaaagattattttccagacttttaagaacccccaaattcataaattttcaaaaagaaacacagtttttaacatgtgtcaagagttactgtcaacttaatccacaagacaatagaataaacctaaatcaaaacatcaatgtttggcagtaaactaaattcactactcagttttgggttccattcatcacaccaggcttaacgccagtgtgattcaaatccaagctccaaagattagcaaaatgtatacagactgcatgtcctgacactctgaggtatgttattaaaaacagtcaaaattgtaaatggtaactctatgattgttaggcctatgtggtattatgcgccgggagttttggggatacttgctcgtgtcctttgcacctgaaggttgaaggtaagtttcacagttttttccactgtctctcagtccaccaccacaactcccacctatacttttcaagcagctctgtaaatcctgtctacttcctgaaaccttactcagttgagtagtggaacacctcatcttcttgtctcctatggacttgaaagaaactcccacacgggatcattcactttcctctcatgacaaacatatccttcttctccatgttgacgtacgccaatgaaaataaactgggatatcagagaaaacatggaaagaaactgtatcctagcaactcatggccaaatataggcattaaggtgcttaaattattagcattcactatgttttttcatttccctaaagtcttattctttgcaagcactttatcagtacttagaaaataaggtggttaagcttcctccaggagctcatattctacgaggggtgtacatcaatcaactgtccatattcgatgtaagtgacagaagtctgagaaatcgctctctggttacgaggaaatgtagcgtgttaatcaaggtaagtgagctgtttctacagagcaagtcctgaaactgctttgcatacatttgcatgttcattgctctgagaagtcccatagtaaaagcaaagcaaagctgagaaaacaacacctacacacacaaaacacttccacaacaaaacaagccaacagaacaacttgcgttgcttgaatgtatttttgtagggtgacttttttctctatagacttgttaatagccctcagattttcctaaatgctagattgagaagcactgaaagatgcagatgttttaataatttaaaagtagataatttttactttacaaaagcattggaaatctcaaaagaaaagtctgtgtcattaatattcaaatgcttgtacgtttaagtcttcttgtaaataatcaggtaaatctctgaatatcttacctagatgtgaaaacatgatttaacaatggatagtgatgggatgtattttaaataagagaatatatttaaatgcagagctaataaatttttaaatctgaatgaaataaataattttctgggaattatataaattacttcttttgcctcaagaaggaatgggagatatgaatagaaaatagccatgggagagaaattttaaaagttgtaattttttttttcatgtttagcaaaaggaagcagaatccatagaggtatccaatttagagaagcctctaaccccaaaacaaatgcatactgataacattcatacaaacaacacttctacaataaaagtctgatggaaaacatgatttgtaatcggtcccactgaaatagaaatgttcagggatttggtattttccatagaaaagttaaatgtataagaaaaatatgtttaggtaggatctaaacatgctcaccagcagaagataaaaatgacaaacaacaatacattttattcaggattaaaaacacttgttttctgcatatgccaaggaaacttacttgcttgtgcttagacatttttacccacattcagaaaatgaagcaaaattcacaaattcaattcataatttctttttaagctgcatataataaatacctattattcatgggtgttggcaaatctgtatactacctatttttttttctatgtttagccttcggagctgcttaaatcttaaaatatgtaccttctttgttgttctctttcttactgtggagccccatggcttggaactgtaagcactgctacagtcccaaacaattctttacttgacccaacaaacatatccgtcaaaatattttgggctatagataacagaacatcctactaaaagtggtttaaaaaataaggacatcattctgtcacataaaacctgagggagggtgatttattcagctactcaatagcagctcaatcgctcagtcttttcccatccgtctgtcccctctgcctttctcattgtgctggtttgtctccttagactggttcctctcatgatccctacaggcctgcagcagctctaaacaccacatacagaggaaatattcaagaacagaaaaggaaacatctttgtcttggtgccaatcttgtgagtaaataaacccttctcaaaaactccccagtgtatttgctctaaattttcattcaccaggattgaatcacatggccatgtttaagtgcatcacttagcaggaaactgagaccacttcacttttttcaaccagtaagatttgccacttaggagccagccccacccccgcacccccacccactggcatacacagcaggttactatagaatgagagtagataaaatctgggtcaatgttataggcaagcaagaaggaagcgtctaacaggcaaacaacaatgtctgtcaatagtctgtttatatgcccagacactatcagataccaatttatattccaaggagtcattctcattggtaggtaagttgcataaatgattatatataatttttgagtaagtgataaacattttattctattttctcatctatatatcaaagctactatagctgaacttcatagaatcacaaaattctaaggcagaagctcctagaaaattaataaactgatctatgataaatcaaatcatattttaaatttcctagggatgctccctacttaagaaagccttcaactgaagtttgctttcactttgttttagcatatccagttttcttaagttggaaattactgtaagtaaatgtgagagtggtacacgcacaatcatttgctttctctctattctcagattatcttgttggacttttaacccaaccacctgctccaaaccaaaatctagatcaaaataaatgttattgactccttaccctatataggatttctatttgattgctcagaaactccagtatgacacctgacataagagagtaaaagcacaacccaagaggcgctccagaaactggatcagcagagacatcttcagaggcagcagacctcagctgggttgaggaccaaacaccaccttcacgttatgtttttcaaggtaacaacacaacacaacagagagaagaggacacgggatgggaaaccaagagggctggcctctaccattcttgctttccaacagattttctgtggcaaggctctttcccttatcttgcagatgaaggagtaaatcatcttcagtgaaattcagctctctcccattaactcattgatttattcacttaactatcaaatgtttattgaacacctacttgcactaaactctacattaaattctagatgtgtggaggaaaacagttaaagtccctccagtcttggggtggggggacaagtaatcactgagcaatccagatgggacgtgttatgaattagataaacttggtgattagcagaaggaagtagaggagagaggtccatttagagtggtcaggaaaggcatcacagaagagggggcaggggagaaagatgagttaggttagacggagaaagaattacaagaacagggaagacaatggatgaaaatgtcaagagaattaaaatgtcgtgagctaacagggtctgacataagatgacggcagagaggaatgcagaagctaggtcaaccaacggccttgtaagccaagataaggagtttttacttcattccaagttaaattgatacattttaaatccacataaattgcttatgctgtagaaggttctgagaactgtaaaaaccgttccctttcttagtattcctgccagaattgtcgacaaacatcacagctacacagaggtgcacagaagaaagagatgataccttgaactttccaataacggtttcttcattttagttttctctttcttttaaaaaatcaaatgggttacaaaatgcttgcggaagcgtgagaacaacagtaacagtttctgcctagaagaatcctatttttgcttccactaaataagcacaagtctgttgtctagtatttggcttttggacaaaacataagagtcagaaaatcacgaccatggaactagggtcaaaattaagtagttgattggaaataaaagaataaatctaatttctgaggactgactatacgtagggaagggaaaagggagaaaagggcttttacattcccttcatgtaccatcctcagcttaatagccagagaaatctagaggcccaatgagatggatcatggggctctttaaatatattttaaagcattcttttcctggtggaattttcagattgtaagtttgttgttgatttgggattttttattatttatttatttttatgtactttttttttttttttttttttttgagacagaattttgccctgtcacctaggctggagtgcagtggtgtgatcttggctcactgcaatccccacctcccaggttcaagcaatgctcctgcctcagcctcctgagtagctggacttacaggtgcccgccaccacacccggctaattttcgtatttttagtagagatgagttttcaccatgttggccaggctagtctcgaactcctgacctcaagtaatccacctgccttggcctctcaaagtgctgggattacaggcatgagccaccacgcccaggcctggatttttttaaagacaggtgtgtatgtgtgggtgcgtgggtgtgtgtgtgtgtgtgtttggggaggagcacacacaattgtatgcaatgacattattggtgggaagaataaacaactgaagttatcaaaactttctaccagagcactggtaaatatgggttgtcatttaaataacatatccctaattttccatccactgccatagtgcagaaacaacttaattacaagtgtccatgggaggctctaaacttctgaggtcatggaaagtgtcattcacagtcctctgtagtctctgctatgattatcaccatgtccacagtaagcattcagtataaatttgtgaaactttattttatacaaacataaagctttatgtcattttccatttaaggcaaccagttttaaatacaacactcaaaaaatgaggatcaaagttgatgatgtagatattgtaaaatgcagagtactagcatactgaatgcatacttatgcactgaatacctactgtgtgatagatgtttattcagtgctttacttacactgtctctaactgctgtagcttttaagactatccatttttgaaaatgctggtgaaaatcaagaatcaaggacagcgaagacgacagttagtgatagtgtaaaaaacggtggctgtaggcatagttttaaatgttcttgagaaaggattactgttaactgcggaaatgtagcaagtgtatctcctatgattcatgttacaaatgtaaaggtggtgtacatttattaacaaatagctggatttaaaaattcttcagtcattttctgttgaaagttttatctacatctgtactttatcaaggcctatttagtttcctacaaaacaacaaaggatacgttttatctttaaactcaggaaggctgtatgaccacaggttcaaaatgcatcctgaggggattctacacctgccgcctcatggtgaaactgcctgaaaactgtctccagggagagcatacagaaatactccggcataatacagaaatcgccttttcgcaggaaactagatagcttgttaccaatctgtttggttggggataacgcatagcaatcctatcctttgtttttcctgatttttactgttcttaacatgcccaataaataccttctcactgttcaagaacaggagtgctgataaacatcatctcaaaactggcatctacacccataatattatattatataataatattagaagcactctccagccactgggcaaatccttcatgagaaaacagcatccatttgaagttgtgaattcttttcttctttaaggatggatttctcataccctaccagaatttttgttatcacaaaatgcacactcttttttcagaattcctgaataatgaaaaatacagaatttatgatcctttgagtaaatttctaacaagtgatgaaattccgatgaagtgtataatgattcctcattttctttatgaaatctatcagttcaactctttgccttgaggacagatgctaaacagttgctctggcaagttattaaatcaagtttctggtttcttgcagggcctttcaacatatccccacagaaagatgaggcagacaaagaaactctgtcaatacacctcatatcattaaaagtaaaaaagattaattcctgaaataatgtaaatacatggtatttttcatgataagcatttgaggacatttttcccccatatcccttaacaactagaattaaatccctctataatgactcatttagaatacatttatttaacaaaggaaaacaaagtaaactgactccattggacaagtttgaaaataattttatgaaaacatgttgaaattaaaaccaagtgtttctgatttgtgattctacttggttgggccagtaactttcatgaatataatttcatataccaatatgaatgcttaatgtactaaataaacaagttgtaaaaaattaattcttttctgaaatggtatccatcacattgcttcagtagaatctttattgaaaagaaaggccagtgcaacgcccaaaagaaaaaaaaaaaaagaacacattcatactccatggtaatattttgcacaattaggtagcattttacattaaaatctgcagaaagcctagcaagagtttcccattgtgataagggcaaaaactaaacatggccattttgtaggccctgattgatttaaccatttttttctctgtgtattttcaaatatcagtaatgctgagaacccaattccaacatttatgatggcggcattcttaaaatatgggacatacaatacaaaatcagcaatttctgaacagtggtacaactgccagtaatcaatggttttttaaattccttattatcccatgggccatttcaaatagtttgtattttccaaatttcactccctttttaatcaatgcatgtgacattctgctgctgtaaatcttaatggaaactatataatttgatcatcatactacaaaattactttcatttaagaaactatgctgccatcagtaaaaatgcatctaaattattatttactgaactgtagtaaaaccctcgaattccactaagaagagtagtcagcataaaggaatcaaaacagcttttccatttcagaactttcacaattgtcaaacaactgctttatcatcatgatgtacttaaattcatttctactattgaatatcaccctctacaaaaagtgttattcaattacgtggttccacagcacactggaggtcagctgttaatagcaaagatgtattatgatgtgcttttattatttctaaggagtgagaaaaataatacgttgtattacagaacctcagtcacagtcaatgttttcattcatttgtaaaaacaggcaattgaatccagaagcacacaaaagagaaaaaaatcttttcatggagagtaattaaagaaaactcttgactttaccatcactaagcagtgaacaaatccacacacacacaaatctgaagttgcattaatgcagacatacaactttcaaataccctttagccaatgtttgagttgctaaaacactagtaatattcattcaaggtgtcttgtcctttaaataccattgctcaccaacaatttaaattaaaaagaggaagcataaagtttgggaattttttcatgaaagtaaaatttttcctgtaatcccagcactttgggaggccgaggcaggcagatcacaaggtcaggagttcgagaccagcccgaccaacatggtgaatccccgtctctattaaaaatacaaaaattagccaggtgtggtgatgcgtgcctgtaatcccagctactcaggacgctgaggcaggagaatcacttgaacccgggaggtggaggttacagtgagccaagatcatgccactgtactccagcctggacgacaaagcaagactccatctcaaaaaaaagaaagttaaatttttattttagtgccataattcagggggaaaaaaaataagaatcttttccattgctctggggagaaacaaagtatccaaccatggaaaggtaaaagagtacatttaatatttcaactcaagtattataatgacagaaagtaaatttctctatgttaatgcataataatttcccagccgggctcagcggctcacgcctgtaatcccagcactttgggaggccgaggtgagcggatcacttgaggtcgggagctcgaaaccagcctgaccaacatggagaaaccccgtctctaccaaaaaaaaataaaattagccgggcgtggtggcacatgcctctaatccaaagctacttgggaggctgaggcaggagaatcactggaacctgggaggcggaggttgcagtgagctgagatcgcgccattgcactccagcctgggcaacaagcgtgaaactccgtctcaaataataataataataatttcccaaagattttgtgccatttgctacatactgctcttcctttgtcacccttggatgcccaattcttatgcaatgcattcccagccccaaattattttaatctccctgaatactctgatgtgtttaccacaatactatctcagttactgccaccattaaaaatagagtattccatataaaagtgagggtttgtttctctaaactatacctattttcatactttattgtaatctttattcttttctcaatgtattaaatgtcgttctgcttttttgaacaacagaatgatcatttcctgataaatcagggtttatttatactgtttaagtaaattcatttatacatttggctttagatctgatagaaggccttggcagaccactttattttttttaacgtgaggactctcaattactttgtgtcactttagtttgctctcctactttttgtagcttttgttctcatctactttcatagcttttaatttccctgtcagacggttgcttggatttttctggaatttatcagtgggtcagcagttggtctacgtttatataggacagaatggctgccagataaataagcattttagtgtgtaaagtaaaaaaaaaaaaaatgctctgagtgaggtttctgggcttttacttgaaataaagtactgtgcttatttggtgtgccttatcttctgtggtcttttttttatacttcttgcttctcagttggatcagcatagttgaggttcatggattcattcaacaaacatttactgattacctactacgtgagttcatgagaataaagaaacagtatccctgtcttcagaaagctccagttttgaagagataaaaataaagccaacaaggacagttgggagttttttgatagacatctgtaaaggagagctgcacaagaggttctccctgggtctttaagaaaagccacaatataagaggtgcaattttttgggtttcttttagacagagtcttgctatgtcgccccagctggagtgcagtggcacgatctcggctcactgcaacctcccgtgttcaagcgattctcctgcctcagcctccccagtagctgggattacaggcgcccgccactacgcccagcgaattttttgtatttttagtaaagacggggtttcaccatgttggccaggccagtctcaaactcctgatcttgtgattcgcccgcctcggcctcccaaagtgctgggattacaggcgtgagccactgcgcccggccataagatatacaatttagttcagcctaaaaacaagaggaaggaggacattttggggagagttagcactactgaatcaactggattgactggagaagtttgtattattcataaagacaatttccaattacataaagaattttaagcagttcaccataaaagggttccatcaaatcagcagaagagctggtcagataccaaattatgaaaaagtacttggggattataccaatagtgaatctggaaatctatttagacttcctctccagaccaaatatgcaggatggtaatagactattctttgaggagatcagcaggaaagtgaagaaatatgataaagtctagaagcctagaagtttaaagtgctctttttttgttaaatgagtacttatgatattacataaaaaatattctgctttgaattgtctgagttaaatgaatattcccagattcagaattctctgttccacttctcccttaaaaattattcctctttaccctttcagttccaccattccaccacctcagtctccctgatgtcattaatgtccctgctattaccaagtccaatggacatgttcagatccatcaacagcatttgagagcagctttcctccaaacctctatgcatgcggcctctaggacacaaccttccctggattttcctccaactctattgtttttctttctcttttctcctgtttcccctcgacttctcatcctcacctctattaattctattaactggggaacccaaagcttgggtcttgaaccctacggcattgttattctcttttttgttgattttgtctaatcccgtggctctgtcaccatttatatgctagcgacttccaagagaatatccccagcccagttttctgagttctggattcaagtatcaaattgcttatttggcatctccagaaggttatttaacagacagataaaattcaatatgtcccaaaccgagctcatgattctccattcaagccaaacaactctaccctcctccgagtgtttcttatcaataaatactacaatcaccccaacaggtgctcttaacacaaatctgggagtcatccttgacatttccttatatactcaccctcaatatatgaggaaataatttacttcctcttgtttattcaacctgcctacatatttctggcatccatccacttctctccaattccacagccaccataagagtaggggccagcattctctctcacctgatcaaccactcttcccttgatgaacactgagtttacagagcaggcaaagttcacactccacaccagagccagcaacgttgtgcagggttggctgccttcccccctcccactccatcctctgcatctccctacacactccctaaactccagccgaattggtttcctctcagtaatataatctcagtaggcatttctgaatgaatgacggaagaaaggaaggaaggagttacagggaaggaggaaagcagagtaggaaggaggatgggaagaaggaaaaaaaggaataggcttaaggtcattaaaaagaaaatctgttcctggaatcagaaaatctgagtttgagtcctagctcattacgtagagtatcatgaacttgaaaatggacttaatgtctcccttacaggggatgcattaaaggttaagtgaggtgatgtgtatgaaagttgtctgtacactatcaaagcactgtacaaacagaatatggaagcttaagacaggtaaaatacccgaggagcctatcacagagataatgcaatttagatggtaaaaagaaatgaggcgagcggatcacgaggtcaggagtcgaagaccagtctggccaaatctctactaaaaatacaaaaaaaaaaaaattagccgggtgtggtggtgtgtgcacctgtaatcccagctacttgggacgctgaggcaggagaatcatgtgaacccgggaggtggaggttgcagtgagccaagatcatgccattgcactctagcccgggcgatagagcaagactccttaaaaatataaaaaataaataaataaaaagaaataaaagaaagttcaatggctctcaatctttttctccctctattgtccacaagtcataactgtataaattcatcatatccatgtaaaacaggttataacacacttctatctgagcctctccttatattactgcaattttcaataagtttaaaaaaagggctcagtgttgaccactccctgacccaaggattttcaaatttgtgtaattctcacaagaaaaatgtattattcccttaatgagtatgatcactttcctaaatttttgttgttgttactgttgttttgttttttgagatggtctcacttgtcacccagactggagtgcagtggcaccatcttggctcactgcaacctccgcctctgggattctgtgattctcctgcctcagcctcccgagtagctgggattacaggcacctgctaccacgcccagctaatttctgtacctaaatttgttttgaaacaaaagtattctataattttaacaaatgcagaggagcacatacaagaaacaaattcccagaagttaaggtatcaagtaatactagttttggattttgaattatttcctgattacttgggaacatcattttccatttctaaaccaacatttccttgtctcttaaaattcataagaagcaacagcaaagaagacataaaagatatatctgcttcttaagttagacagcagttaaacacataacaaattgagaataaaaaataatttatcatattcacataaaatagttttaaaggaagcacatacatgtcttggtagaaaatgtctttataattatgtatcacatgtttattacttactagattaaaacagtagtaataataatctactgctgatatagtaaaggcaattccctaggtgtttcttttggtaatagcacctagcatttatatttgttaagtgtatttttccatgagcagagttctctgaaagctctatcaatagtaataaaaatggccaactgtgattcggagcatttagtcagcactgtatccatatgtgtaaattccaagccaggcattcatttcaactcaattctgctgcttcactactgctatcttgtcgaccagaaaagtacaggactcaaattctcccaaagaactgccagactcacttagtccaagcaaaggagaaaagaagccaattatgaattttattacttccacaattctcctcaagagaaacattataagaaagaacactgaattaaaaaaaaagaaaactgcctcgtttccaagggatcttgatcaaaccaagcttactacggaagttcttctgaaattagatataataggattttcagggaggtttgatatttatcccaaggtaaaacaacttcttaccgctttacctttcctttatttagtctgactcgaatattattgtagttattggattagagattcattttaaaaagcaacttttcagacttgaaatagctttatggaagcatctcacatttcagcagctaaagacaagtgttcatggttttgccaattcaattcactagaagccatctaagtctgcatggtctctcttttttttccttcccctactgtggctttgaagtttaaaaagaacttcatatatttaggaaacagagcgattatcccaaggctctgaacttgagcttaagaaaaaaaagcgctcatctcaggagcagagatgcgtgagcatatgccaggcaggaatgcatgtcagagtcctttgatggaaattcacagtctcagagatgtacccaagcaaagcacaacaaacaatgaaagctaattgccaagagtcagggttgtcttcataatgcattgcatctgcatagcttggcgtccagtgttaattaaccacagccaggttgggattgcttcctgatttcactgcagcatgcctctgaagcaacagcaatgtccacaggttagcattatcctcccgtgccactgtccccgctggacagcacaaaacaccacaaatgaagaggcgaatgaagaactgaaatggcagttcttatgggatcaaacagaaaagcactgagttttactattttattacttcctttagcagggatcagctccaatcaattaatgatttaattacctagactaattaagataatgaacaacagcaagcctacaatcaattagctttatccaaactttctattttgagtataggaccttaaggactatactctatgtctttgttgcagcaataaaatatgtgggtatattacggaactgccagggatgtggtcactcccaaccttaagcaaacatacaaggtcacttgaataattctttggtgacagaaggttgtgaaaggatgttacctggatgggcaatggatatttctccatcagaaatgcagatcttaaattgaattatgtctctcaaaagcaagtaatggaccaaagacaggaacatgcccttttggtcagccagcttctgtgatttgagttacttcagagtaaccatgtaaaaataaaaagcccctttcaaacatccagcagaaagtagcagtgtttcttgattacattgttcttgggacaaagtgttccttaaattacttagcatgggctaagaaattcatatatttcctaagaaagaagtacagacaagaagcaggcagttagggaggtgagtagtctaagttctagtttttcctttccatctgttacatctactttgaaatttaaggcttaatgatctgattccctaattatattgggtgttcctcacagagagaaaaggtctcctactattgggtttaaccatggccactactaaagtataatctattattgtctacaataaatatttttcaataaccttttcctcaagcaagaaaccatataatgcataccacagtgttcacatctgtcatctcccaggtaccacatctctcggcttacctatactggttgtgtattgtctctctcagaataaaaatgatcatagtgcaagtttccttgtatgtgccagcagtattgcactatgcttttaggggaacttcaaacttgcccatggataaaaggcattaagattttatacctcacaggctaagctagctctgcaccatgcaagaaaactgactcactttccaaatgccttctaaggcacctctgaaataaaggggaaatctcaatccaacaaaaatggatgccgtgtataaaatttatatctgttctttgttcagccaaccagttattgagagtataccatgtctcagccaatgtgcaaatagaacatagaaaaagttatttaatatcacctcatgtctgttagagtggttgttatcaaataacaaaaggtaggtgttggtgaggatgtggagaaaagggaacccatacacgctactggtggaaatgtaaattagtacagccattatagaaaacagtatggaagttccttaaatatgaaaaatgaagctacaggccaggtgcagtggctcacatctgtaatcctagcactttgggaggccgaggtgggcggatcacctagggtcaggagttcgagaccagcctgaccaacatggtgaaaccccgtctctaccaaaaaaatacaaaaaaaattagctgggcatggtggtgggcacctgtaatcccagctactcaggagactgaggcagaagaatcacttgaacttgggagtcggaagttgcagtgagcccagatcgcaccagtgcactccagcctgggtgacaagagcgagactctgtctcaaaaaaaaaaaaaaaaaaaaaaaaacagagctaccatgtgatccagcaatcccactactaggtctatatattcaaaggaaatgaaataggtatgtcaaagagatgtgtacattcccctgtttattgcagtaatactcacattagccaagatgtggaagcaacctaagtgtccatcaatggatgagtgaataaagaaaacgtcctattatgtacacagtgaaatcctactcagcctttaaaaaaagaatgaaatgctgtcatttgcaacaatatggatgagtctggagaccattatggcaagtgaagtaagccaggcacaaaaagacaaatactccatgatctcactcatatatgggatctgaaaaactgatttcatagaagtagaaagtggaatagtggctatcagaggctgggtagggggttgggaggggttggggagatgttggtcaaaggacgcaaaattttacttaagaggaataagttcaacagatctactgtacaacatggtgactacagaaaatgtgatactgcattcttcaaaaatgctaacagaggccaggcgcagtggctcgcacctgtaatgccagcactttgggaggctgaggtgggcggatcacgaggtcaggagatcgagaccatcctggctaacacagtgaaaccctgtctctactaaaaaatacaaaaaattagctgtgcctggtggcaggcacctgtagtcccagctactcgggaggctgaggcaggagaatggcatgaacccaggaggcagagcttgcagtgagccaagatcacatcactgcactccagcctgggagacagagtgagactccatctcaaaaaaaaaaaaaaaaagaaaaagaaaaagaaaaagaaaaatgctaacagaatggatgtaaagtgttctcataacaaaaattataattacatgaggtaacacattggctacttagccaaatttagtcattctacaacatatacattaaaatatccagttatattcagtaaatacatataatgttgtctgtcaatataaaaaaattaaaataaaaaagaaatcatttagatcctaatggaagagtcagtctacataaccaaatacaggaatcaaagaggaaaaaagtgactagagttataaaatatgtttggtgtgctaagggaaaggtaaatagggcatctttaagtgcaataaagatgggcaaatgaagataatagagagtgcctcaggaattaagcatgtgatctctgaagtcagacaacctaggtatgaatcacagcttattatttattatgaacaaacagcgaacaactacggacaaattacttaacccctccaaactacaatttaccctatcttaaagtctaggctaataagggttcttaaaacacatgattgttattaaataatctgcgtgaagcaaggtgcacgcacatcctaagtgcccaataaatattagctctttgttactaatattagaagcttttttcctggcaatagtggaccatatatgctcctggtaatgagctacaaccctttgcaagaaagcaaatttctgaaagacttggctctcttaaaggtctcagggtcaagtacattcagctcatgttcattagctaataacattcaaaaggtaaatcaagaggatattaaaaaataaggccatgcagggtggcttatgcctgtaatcctagcactctgggaagccaaggcggtgggtcacttgagcccatgagtttgagaccagcctgggcaacatggcaaaaccccgtctctacaaaaaatacaaaaattagcaaggaatggtggcaggcgcctatactcctagctactcaggaggctgaggtgggaggatcacctgagcccaacaggtcgaggctgaggttagcagtgattgtgccactgcactccagtctgggtgacagagtgagaccttgtctcaaaaaataaataaataaaaataacaataataataacagtaataggatatcaaaaatgtgccctttcataattataaatgagtttttatgtcagaattaacaattaacgattttatatcagaaataataattagtataatctaaatactttagataagtcttattaaaaagactttatttctgagaactttacatatgaagggccttcaaacatttagtgttcacagaattattctcaggatctccatcaaacgaataaaactagccttaaactttaggctgaaataaaaattcaccttggtaagcactttgattatcaaaatatattgctttcaagtaacatttctactaagtttgggaaattaatttaaactccatgtgttcttatgtaattaatgctagatgtgaaagtatcttactttattttaatgtcagatatccaaaatgtccaatttatagtaacatttaatgttatttcatgccataactcaacataattaattaactggttgttaaatatcattataaaacactgtaagaatcactaccaatatatatgtaagataataatatatttcatcagcaatataaaataattgtcttggtaattaaggaagctcatttagttctagtaatagtttattcaaacatataattatactgtatagctaacaagtacgccttttaatcaaatatataattattaaaatattcttgagggatataattggcatattataaatatatttctatcatgactacttaaacctcaataaatgtacctttaaaaaggccttgatttaattagcatacagtaactctctccttgaaatgaaattaagtccttaagaaaaacaactaatatgaagcataatcttatattactcaaattactaaaccttgccaagcaaaaataataataaaaacccttcgagagctcatttaccaaaaatacaaagatcacgtctccaagcaataattctcagcctgattgcccagcaggaccatgtagggagcttttatgaaatctattagcccagaccccatctacagagattctgattaggttggttgggaggtgggcccaggtatctgttggttttgctttttagaaagtccataaaccaccacaccagagactgataaaacgtatttctcccagcccataaatgtttattgtagcttcattcataatcaccaaatatttgaaacaacccaaaggaataaataaaactgtgatacggatataatgctacgcaagcaatgatctattgatttatgcaacaacatggatgaatcttaaatgcattctgctcagtgaaagaagccagacccaaaaggctacatattgcggcagtgtgagggaaattctgaagtgaaggaactgctacatgtaattgtagtaatgaatacataactatgcatctgtcaagactcatacaacagtacaacacaaagagtggattttactctatataaatttttttaaatcgaccaagaagtaggggagggagggagatgcaatgcagagtgtgacaaatgaaataactgtcttacaaatgtatcacataactatattgaaggagacagggatggagctgtccttagtaattttggtaaacagtcttttggctggatattgtaagagtaaagacagcctgtatcaacagtattttcttgttctgaatgaaaaagaagtcattatttattacaaatatttagcttactgtttatcaattgtgtgtctttaataatgaacaacactaaacaatcttaaaatctgaaaggttttgtaaaaactttttactggtgttattttcgtcactatgtgccttttttttttttctttttggaaagaagctgggcaggatgagcatgtaaaggcttcttcaaagtgtgaaagtggacagatactgcctccaggatccagaacaacagtcatttacaaagctagagacagaatgcactgaaaatacagcaattttacaggtagttccagcaggggataatttatctaatcaaacagctgatctcctacatattctactgtattcagtcttttcatgttaataaaatttgaatatgcaaagatcgtatcaattcttttttggggggtggggggcatggactttccctccttgttgcccaggctggagtgcagtggcacgatcttggctcactgcaacctccgcctcctgggttcaagtgattctcctgtctcagcctcccgagtagctggggccacaggcacccgccaccacgcctgactaatttttgtatttttagtagagacggggtttcaccatgttggccaggctggtctcaaactcctgacctcaggtgatccccctgcctcggcctcccaaagtgctgggattataggcgtgagccaccgcacccagcctgattctttaatatgttacaaatctcaaaataaaaatctcagaaatctaggtatgtgtgtgtgctttttatttataaaacagaatctgagaggattaaaaagacttaaaaacaacaacaacgataacaaaacacaacttctcctgcataactgtcagtgccagaatttcagggtcaaacatttgatctgaaatttggtatccagttcgctcctaaactgagtctccaattgtccacttaaaatctttatccactgagcttttgcgggtggcggcgagcgcggagaggacgccatgaaggcctcgggcacactaagagagtacaaagtagtgggtcgccgcctgcccactcccaaatgccacacaccgcccctctaccgcatgcgaatctttgcacctaatcgtgtcgtcgccaagtcccgcttctggtacttcgtatctcagttaaagaaaatgaagaagtcttcaggggagactgtctactgtggtcaggtgtttgagaagtccccgctgcgggtgaagaacttcgggatctggctgcgctgtgactcccggagcggcacccacaacatgtaccgggaataccgggacctgaccaccgcgggcgctgtcacccagtgctaccgagacatgggcgcccggcaccgcgcccgggcccactccattcagatcatgatggtggaagagatcgcggccagcaagtgacgccggcaggctgtcaagcagttccacgactgcaagatcaagttcccgctgccccaccgggtcctgcgccttcagcacaagccacgattcaccaccaagaggcccaacaccttcttctaggtgcagggccctcgcccgggtgcgccccaaataaactcaggaacgccccggtggaaaaaaaaaaaaatctttatccactgacgcataacttggaggaccatggtgagaattagtgaggcctgaccttggtacacagtgactcaatttcaggctttgaatcagttagtcctatcagaatgctacaagtcagagtatcctggcaagaaatttactattggccataataatgaataacggccctaattaaagcctaaggtggatcagatgagaagcgggtcacaaacctaaagagatgatctatataatctacttgttcttggacatccatcacttcaggagaaaatttttgtgtctcagttatcagtgccatcaagagcaatgattattttccatattgtaatcagagtaatcctaacaaagcacaaatataatcatctttacctttcccctttaacagcttattgggtttttttttgttttgttttgttttgttttatatcacggcctcctttattctgccctttgcagacactagtcatattcctttgagccttggcacaagcttttttttctgcctgttggctcttaaatcccaacatcactagcaaactcctaaatactcctgttgcttccaggaagcctgacctccagatagcttggtgcgcagtagaatacctccccattataggatctctgtacaaggtttttctcctaatcctttacattttctccattcattccccttgctattcctagaacctgctagtcaaggtcctgccctagggtctttggactggctgttttcctggcctggaatactcctccccatggctaacttccctacctccttcaaatctttgcttaaatgtcactttctcactgacctgactacccaattttaaatcacatctgaacccctacccacccccatcatgcaccctcctgatttcccttactctggtctttctcccaccataatacttaggtcacctttgaacacataatatactttcctatttatcaattgtattgtttattatattgtatttattgttcaatttcataatttagagccccctagaatgcgaccttaatggtgcaagatttttttttttgtctgtcttggtcactgttgtatctcaaaagcctagaataaaaagaatatctctgaaatgaatgagttgcttaaggacctatatacaagacattcaagaagaaagagagaaagctcacacttccaagacctgaacaatatctgtgagttaaaatgtgaatgcacaaaagatctatgaaaaaaaaaaatagctgctgtaaatttaaggtagcaaattagaaggtgtcatcaactaagctcagcagaaaaagcaaatcctacagctacatcgaccaattatgagcctctaatcgctgccaggacctcaaacacattatcccagttaattctcacacaacacataacaactgcaggatgaggttctcacacccatttcacagatgagcaacctaagattagcctggaagctacaggagtgcacagaccctacctgttcccatcttgccatcataccaccagcatccagcgatatgctggcgggcagtaggtgtagaatatatagaagctgcataaaattaaaaaatatatatgctcagagaggttaacaaacttgaccaagaccacttatccagtaaatagcaaaatacaggatttgaactcagatcattttatttaaaaaccaatgctcttcccaccacaccatatttcttctaactaaagttataaaacacatacggacctacaaaaatgcaacagtcaggccaacgatctaccacagtcattcctcagggcctcttaacagagaaaaatataaattgatattcctaattagtgtcacctcaataatcaagcagcaatcatgtttcatttgatctctttaatattgagacaggcaaagtacattctagagacaattacaacaaaatagataagtttaaagtttagcaccaaatgtttagccttcagacaattcaaaagtcattttcacagaaatagtacacagacattacagtatgagtaaattcctgcttctacttagctgctcacttgggcaatgccctttggagcactggcccttgaaatgctaattcactggctgaactactgttcacctgctctttagccttaacaggtctgtggcttcacattgggtagccacagcagtccctaagagaaaaaaggagctccagcaaccaagctatttaattgcgaaaaccgcaattacctttgcaccaacctaataacctaataacttgactccagaggatggatgaaaccaggagaagagagggggagcctctctccccacccttgggctaggagacacctaaggtctgtaaacctggcattgttagaacctacaaggagaaccaaaggatttaaatgaataattcatcatcccaaattcacattcactagaagtatctatgtaattgtggttaaagtacttcaaatgtgtccttctgcttcatattttagtgtaagatactaggtaatagaatccattctctaattcactttacacaaacagaatcagcccaaatgtttgctgccaattcttacatttcctattgttaagcacagaaatagctggaaactgctggtattgagaaattttattcatttcagttctacaaatttctagaggccctacacagagattgaaagcctatagtcgcagacgagatccatcccaaagatgtacttcctttagcctcaatattattgtaaaacctaggggatggttcacatataaacctagactttaagctgcactaggaaaatcaaaggatccggagcatgcactcccaaataggaagaagagaatgggtggtggcttccctcatgagatacaacacaaactttcgaaacagttgaactggcctacctcaataatgaatgttactctcctggtcactggctgtatggaaggcccagtattggaatgtagggggttgggggtgaggcagaatctgagatgaataaataaacttgtatgagaattgaaaattttaggctgggcactctgggaggctaaggggagcaaatagcttaagcccaagagttcaagaccagcctagacaacgtggcaaaaccccttgtctacaaaataatacaaaaaattaaccaggcatggtggcatgtgcctgtaatcccagctactggggaggctgatgtccttgagcccagaaggcaggggttgcacctgtaccccatcctgggtgacagagtgtgtcactgtctcaaaaaagaattaaagaaagaaaagttagacaaatacatctaaaagtaacatatgaaaactatgatacctctaggagagacacaaaaaccgtatcaatgtgcattaggtgtgttggggggagaagcagggatggaagagaaatacacaaagtgtatcctccccaacctacgtctcatcctctctggctgtcccttctatgactcatcaagcacttataaagtcaactcatcatgacatcctgcaaattccacctcttgaataagttttgtatagggtcctttggtatcccatattcaaaaatacagttcagatcctcaagaccctcattctatttgacttcacagcagtctcctaactggtcttccaccctccaacgcatcctccacatagctgccagtgacctattgaaaattcaagtcaggccacaacacttcccagtttaaaactttcactgggttccctagtaatttgtaatactcagcctcacttgagaataaactgaggggcattttttaaattagctatgcttgatcctcaccttcacatgtttttattaaattagttggtgtggggcctacatgtctacattctattccaagtgattctgatgttttatcaagttgagaatcaccgttttaccggacaagttccaagatcattagctttgccttaatgccctccacaatttctctgtctccggcacacctatgaacattccctgtaaattccaataaggaacccgctcctggtagcatcctgtgcatatatctacctcctgccctgaattccctttattataattatctttaccactagtctgacagcagtgacttgggtctatcttccttgtaactcaaatgcctgcaacatagtgagcactaaataagagtggatgaagacagcagaaaaagatggacctggaagaggaggtgagacctgaaaggcaaagctgtgaagtaagaaagggagaaggggagaatgcttgtaaagctggaaaatcagaaagcactttttgggctagcaaaatgttggtgatcataatttgtcaaagctttcttcaggctagaaaaagcaatctagtggcctgagtaaatacaccaaagggatttaagccaattattccctgcccagtaggggtgtcagattcatttgttaaactacaagctctctagagaaactagatctcagaacgcaagtaactgttttattataattatcataatacccctcgtttccctctcactccaaatcacaacaattgaaatgaaaaagaagtatgtgttgttcagttgctaaatagtctttttataaccttttctgatgtagtttggattatttcagaaatagtagttctccacagtggtttctgctgcttacatcaaatgagtcatgctgtggggctctcactctttcccctgagagtttacaccatagttgaatagacttaactattagtcattttccttcatattaagccaagagttttgtttaatctaattagtccgccttctctatacaattctaaacaacctcagtccttacaagaatataggtatgcccttcctacatctgcagaaacgtgtgcctcctatttactgccaggacaagctgaccatagttcgttcttaaattttcccacgtgagccagggattccaattctgaaccttctcattcccacctcccacaaaagcgtttcagtttgctggcacgatggagcgtagtgttatttccgagcgtttgctgctggatcaatggtgttttctcattagttttattttgcttttgatttataagcaccaaaatggtacagagtatatctacaccagaagcatctataatgtgatcaaattcaccatgacttttgtgcttttatttgcctttatgaaaccaatctcaggcttcgagacccatgattacaaactgtttcttcacagaccccttacaactttccaagcaaatgtaatactttccagcacttttttcctcttttttaagatgttcatagctccaaatgtcaggcacaccgtgcaatgaaaactatccctcagctgataaattattcatttttcaggagtttgcaatttgaaatggcactaacagctgaatacctgaagcacccccaaaagacatgaagagcaataacatgcaaagctttttctgcatacattttaaaggttaagcgccattagacatctatgtttatcaagagatgtgctccttgaacatatttcttctaattaatctgctcccaataaacattactaacaaagcaaagtgataaaggaggctaatcaaactaatctcttccctttaactaacttcatcaggttaaacaaggtcctttgctgatattctccactttctcctgtctgatgaggagttgcaggtgagtaaggtcaaaagcaggagtgatcaaactaggactcttgaacaatctggcccactgcacgtatttttaaataaagttttattggaatactgttttacccatttattttgtattggctgtggctactttcttgttacagtggcagagttgaatagctgtgatagagacccacaaagccaacaatatttaccatatagctctttacagaaaacatttgctgacctctggtcaaaaggcatgcaaaatgtataaggcttttaaaatgttagcgccaagtagggctttagctaatgtatatcaatgtgttcatttactctaaaaaaaagaaaaagaaaaaaaaaaaaccttgcatttaaaagtgtgttatctagaataccatctgtgttacagttccagaggaaactgcaggtctaagattgttcctcaagctggtagatgcttcattttgataacagtaatcaccatgtgtttcagctatttattgctgtgttaaaaaccccttcaaaaatggcttaaggcaaagatttctttgcacatgattcttccctccaggcctcagctagaagattttaaactccacctcccatgtggtcactcatatggcttatagtcatgaagaagaggctggactctggctggaatgccaagatggcttggctcttatatctagctcctcacctgggacagctgcaacaggtgtgggctggctgagtatttctccctctctgtggggtcccttcagcagggcagttgagcatcttgctatgatgactcaatatgtcagagagtgaaagtagaagcttccaggctgctgaagggccaggcccagagctggtgtactaccacttctgcaccctcctattactgatcaaagccagtcaggggactaacccacattcaaggagtggggaaacggactgcaccttgatgagaggaactgtaaaatattttggccatgatttccaatttaccacaccatgatgatgagtaaaaagtgacaacatgatcacaatgacaaaatcttgaaagcagaccttactgctgacaatttataatcaaattgacaaataagaacaagaaagcctaataaaagaatggaaatcattttatagtgaaacactagtcacacagaaatcaaaaatttccaaattgatgtgtttttttttaattgaaattagaagccattctaaaagccactcagtgcttctcaattcttacacagtgtgtaagctgtgactgtgacataactttcctccatgactctagggcctgaagatgactatcaatgaggggcatagtaactacaatgaacctggataactctggacctgatgcccactggcatctcttgggccctctggctgctgtgcattttgagctctcttgcctgctcttttcagctgttctgcctcttctctggacagggaatcatgagtgtgtgttttaggtccttccccatcacctattcacctttttgctctaggcaggtcatctactctgacccttggatttttttttttttttttaatctgagaagtgaggaggataaaaattatgttgcctacacttagaatattcaggaacaaatgagattaagaagataaagtgtttaaactggctgggcgtagtggctcacacctgttatcccaacactttgggaagccgaggcagggggatcatctgaggtcaggagttcgagactagcctgcccaacatggcaaaaaccccatccctactaataatgcaaaaattagtcaggcatggtggcacatgcctgtaatcctagctactcgagaggctgaggcacaagaatcgcttgaacctaggagtcagaggttgcagtgagccgagatcacaccactgcactccagtctggacgactgagtgagactccatttcaaaaaaaaaaaaaaaagaaagataaagtgtttaaatcattattcaagtattcaagtgaaaggtatcacaatcactgtggtaattaattaagataaaattaattttattgataaaaataaaatattaacaaaattaatataccataaaatagtttataataatggctaatgtttatttagcatttactatgtgcaaggcatagtactaaacaccttacattgcttaacctgcttttgtctttacagcaatcctataattatcatctaatactccagacaacaaaaactgagacataaagtgataaggcaatctgcttctggttttacagatattacacagaactacgatttctctttcccaattcgcacagctgatttcaagagcttgtgaaaggtctatcatatttctaacaaaatttctcccttccaaaccccatattaattagaagggcattatctatctctcctaacctctgctccaaccttctgttccaaagctttcacaagcaacatcagtggttctcaattgggtgattttgcccccctcaggggacagttctcaatgttgagagaccactgggttgtcacaactggactgtaagctgcttcctgagtagaattccttgataagaaaaatcatctcaataggtcaaaaatgttaaatagctgatttctccatacattaagtattactctgtgtgtgtgtgtgtgtgtgtgtgtgtgtgtgtgtgtgtgtgtacagagagaaagaacagaatgaaaactgaacctcacaggacttcacattcaggatctcatttaaacttcacaggagcctgtgagagctgtgagcattgccaaagggtcagaattctcctacctattctcaattatcctcccaggagaattgagaaaattgctcctggtaggcaagggagccattatttaaggcaaatctggttactaacaccatgtactattttagagaaaacatttaagttatggtttaataatcattttatgtattaccttacattcccattggtcttaaaataaatccaaatatgttaaatcatataaacaataaagggtttttttttttcttaaatggaagaagtttaccaggaaatattttattaaaaagctttaatctatatagggacttcaacaaatcacttaggaatcctattgctgtaattttgacaaaatggaagcatatagggaaaagccctattgaagttcctttcttccctgcaattctatgttgaccatcaccctccaataacagccttactttacaaatgtaccgtccttcactatctgcagctatggatattgatgaaggaaagtgtagacttaattgcatgtttccaatgtaaaactatcatctgctttaaaagaaaaataaaactgaccagagataacgagctaaaagcagacatttgtgcttttatttaccaaagtctttggtgttgcaagtctatatcggctggtgcaaagaaaatttcagttaagctgtttagacagtgagtttataacttgatcaggaggttgtatcaaaccttcaatgcactatttgtggaaaaatatatacacattttgtcctagtagagaacagtagtacctaattcaagtttaataaatagatgtcccaataatatatgtgtttccctacatactctcctatacctagcccagcaatccgaaccctttatacgacctccagggccccatgatgtgtctcctggaccttattttgtcctttgaacacactaggctccctccttgcactaaggtctttacactcattcccccatctgcctggatgctctgaactccattttttcatagctggacccttcccattcttcggctcaagtgttgtatctcactcagtaacaccttccttgacatatgacaaaccaaaccaagacctatcctctcccttcatatcctctcttactctcatattacatcatgctgttttacgatctttgcagcatttatcactctccaaagtcacgccgttcagtgacttgttgcccatagccatgtcttgctgcactgctcctttctccacaacatcccaactagaatataaagtctgtggtaacaggaatctggatctggcttattggaggcacactgtagtcatgcgctgaatgaaaagtattattacttttaaatgaaatgttactgaaatttgttttaaaagataagtatagatattagaggagtttctatcaacctaaaatcactgtagattaaaggtttaaatgacttttagtgacaaacaatggcattttatttttctctcactcctttataagcatcttaaaaaggtttaagtatatgtttctctatatatttatctttacacacaaaaaaactaagaaaacatacttggtttagtagatttgttatactttccgtatttttagcttaaaaggaatagattgtgtgctattttttaaactgacgatttaagtacttagtgtatcttaaagccacatttaataactgtagttactgtaaataactgccacagtactatgttgatttttgaaaacctattgcaaattgtacagtgaatttaaaacttttatgagagaacaaagctaaattgtaatgtcttttgtagtaaggcactgaacttcattgttttaaactgattctggattccacatttttaacagatattaacaaaaagataagtttagataaaactatctgaacttcatgattaaaaagtgaaattacaagactgagtaaagataaatttggggggaattttttaaatgccatgttaaaaacaaaggattacttataaggtactgaatacactttaggtcccttcttaacatggttttctccttcactctaaattttaacaatctgttggtggttcagttttagaataatgcttcttcacaaaggtcaattttaaaaaatgtttaagtgtcaagcagtctagcctccttaaacctctatcaccctggtcccttgtaccacatctactccgtaacttccaactagcctcttaacagatctcaaggccactctggctggcctccctccaaagaatttttccaccatgctgcctcattgctcttttaaagttgtaaatgtcttcctatagcagcttaaaaataagtcagtgattcctgcagttcatagaataaaaaccaagattttgaacaaggtttatggagccttgtcttacccagtctccaccacttagccaggctcatttatttttatcatgtctgtaatctcagcacgtcgggaggccaaggtgggtggagagcttgagcccaggattctgagaccagcctgggcaacatgaggaaaccccatctctaaaaaaaaaaaatacaaaaattagccggacgtgacggcacgtgccagtaatcccagctactagtgatgctgaagtgggaggatcacccgagcccaggaggcagaaggtgcagtgagccgagatcgcgtcactgcactccagcctggataacagagtgagaccctgtgtccaaaataaataataataatagctaaaaataagtgcatgtaaaaactggtaaaatctaaataacacatgtagtttagttaacagtactgtgcaaatgttaacttcctggttttgataatgtactgtcattatgtaatatattaatattaggaaaactgaatgaaagctacatggaaaattcctgtatgattgttgtaatgtcttttaagtgtaaaattatttcaaaatagaaaaaataaatcactccctcaggaaagctgtggattacttttcagaacagatgagccacttggctgcttattttcttccctttaatgcttgttactgttagaaaatgtaaattttaaaaattaatgttaaatatttggctatgccactagagtttaagctttttaggggcagggatcatattgcttttaatccacattttatcctcagtagttaactcaatgcttggcacgggaaatgtgtccaataaacatttattaatgggactgtgaaagacatgaatgagccaatcagtcaatgtcccttgaaatcataaatgtatataaatatacatatttacattttaaaaagattctgctcaaattgtgaagttaatgggataatatatgccaacagagatctaaacaaagatgcttctaatttggaaatgacacaaactaatgagaaaaaaaggcataatagcaactaacaacatttagtgaatatttaatcctattattcaaaatgctttacaaacagttatttccttagtccttgtgataactgtatcaagtgtgtgctatatttatcttcattttacagatgagagacacatagagatttgtaccctgtctgtggtcagagtaattatacagcagaagcaggacttgaacacaagcactctgctccagggtccacattctttatgcattacttactgccgagagacaaagtctgagaagattgcttgagagcatcctaaacactagctatgaattctgaagatagattacaggctggtgtaggcccacactgtttaaaatttttatattcccaccacttcacacagagctttccacatagcagacagacagacagacagacacacacacacacacacacacacacacacacacacacagtttagtgaagaaataagtgaagctaaagcaaactgaagaaaaaagaatatactaaattttaggttaaagaattggttctaaaatggtatctccatccaatcacaggacctttctctttaattcttcacttcatgatagaggctggcttggagtttctgaattaacaagaaacacatctacgtaggcaggaggggatggggctcccaaccaagtcaaggttacttgaaatgggtcaggtacagctgggtgtggtggctcacgactataatcccagcactttgggaagccaaggctggcagatcacttgagctcaggagttcgagaccagcctgggcaagatggtaaaaccatctctacaaaaaaatataaaaattagccaagaaggccgggtgtggtggctaacgcctataattccagcactttgggaggctgaggcaggtggatcccctgaagtcaggagttcgagaccagcctggccaacatggagaaactcggtctctactaaaaaaaaaaaaaaaaaaaatatatatatatatatatatatatatatatatatatatatatatatatatatatatatatatgacagccaggtgtggtggtgggcacctgtaatcccagctacttgggaggctaaggcaggagaattgcttgaacccaggagatggagtttgcagtgagccaacatggtgccactgcactccagcctcggtgacagagtgagactccatctcaagaaaaaaaaaaaaaaaagattagctaagcatggtggcgcgtgcctgtagttccagctactagggaggctgaggtgagaggatgacttgagcccaggaagtggaggttgcagtgagcggagactgtgccactgcactactccagcctgggcagcagagccagaccctgtctcaaaaaagaaagggaaaagaaaaagaagtagatcaggtacatagaaacagaatgagaggaaaattaaagaagttaagaatgttaagggaataaaaccaggagatcacacaacagtagaatcaaataccaccagactattacaaataataagaattagttcacaaatactgttgataattgttccatccttagagtttagggcctattcccaaatagagataacaaacaggtcacactttggaattgtttaaaaaagcaagtcctactatactcaataaaaaatgctttgaaatgtacacgtgttgattttgtgacagagtcttaatcttactaggtagctacagctctgctgggagcaattaattcaaaaagccacagaaactccacaatgaggctaaaggatcagtaaaatagctggaatactttccttgcttcagacagctggatgctgctaatttagctactttaaagtgaggggaggaaggaagagggagtaattttgccacacctctactaatttagagaaaagagaaacaatgaaggctgataaacatggctacgtgtttatcatgtaaacatacaggttactttcagattgcatatactaaagggactctaaccaaagaactagggtaagcagaaattgctttttgttttggtttaggtgttttttgtttgtttgtttgtttgtttgtttgttttgagacagagtctctctctgtcacacggctgcagtgcagtgatgtcatcctaggtcactatggccttaaactgggctcaagcaatcctccctcttcaacctcccaagtagctaggactacagatatgtgccaccacaactggctgttttttttccttgttttaacagctttagtgagatataattcaaataccataaagttctcccatttaaagtatacaattcaatggtatttagtatattatgtttatactcagtaccaacactctaatctaacttaagaacatttttgaggccaggcgcagtggctcatgcctgtaatcccagcaatttgggaggccacggcgggcggatcacctgaggtcgggagttcgagaccagcctgaccaatatggagaaaccctgtctctactaaaaacacaaaaaaattagccaggtgtggtggcacacgcctgtaatcccagctactagagaggctgacgcaggagaatcgcttgaaccgaggaggcggaggttgcgatgagccaagatcgtgccattgcaccccagcctgggtaacaagagcaaaactccatctcgaaaaaaaagaacattttcatcatcccaagcaatttatcttttaaaggatacttaaatgatagagataacactcataatctaaaacaaaaacaaaaagacatttttattttactttctaagaatttttgtgcagatgaggtcttgctatgttgtccaggctgatcttgaactcctgtcctcaaatgatcctcctgcctcagtctcccaatgtgctggaattacaggcgtgagccaccacacatggcaaaaaccaaaatctttttaataagatatgtttctggtgtaaactgactctgcctactgaaatgtatgcattttaataatataagaaagttatcctttcctttcctaacttttttgggaagatctcgccaatttctgcaagatgcaatcatttgccctgctttcaacatcatcattttcctattcctttaaaaaaatgtttttggctggcacggcggctcacacctgtaataccagcactttaggaggctgaggcaagtggatgatttgaggttcgaagttcgagaccagcctggccaacatggtgaaaccccgtatttattaaaaacacaaaaattagccgggcatggtggcaggggcctgtaatcccagctactcgggaggctgaggcaagaggattgctggaaccccagaggtggaggttgcagtgagccaagatcacaccactgcactccagcctgggcaacagagtgagactgtctcaaaaaaactaaaaaatgtatttttttcctgcaagataattcctggtcatatcaatggccactcactctctttctcaccaagctcaccccctaccttcagctttctgaagaggcactgtattactgtgtttacctacagtaaatttctatagttccttcctgtgagctgctcaataaaatgtatgtaagaggcaaccgtacaaacagaggaaacgccttctactatccattctacccaagccaaattaattttaaatgtgtaattctaagaagcctttttttaaccactttagactaaagtagatatgcttcatatttcccctcttgatcttcaatttaatgcccggaagcaagggtttataagaactcctacatataggactttgcagagaagcaagctggagactttaacttgctacaagaaaacctggcttatccaccacccaaattttgataacctctaggtcaaattaaaaaaaaaaattagcacagtgcttcacacgtgctcaataaaactgtttgctaaatcttgttgaataatgatataataacagctaacattcacgaaacacctaccttgtgttatctgctaatctatgagttttcttttaattcagcaaatcctcgcaaaacccaggagtattatatcatgaccatcaccgtcatccacattttaaaaataggaaaactgaagcaaagagcaagattgatcaaaatgacaaagatatgggaaactgaggctaaaagcatgatttaccaaatcacagccagacttcaaaaccagactatggcttcagagctcacattcttaaccactactctatgctgcccatcaggaaatacttaagatagcaaatgattatcttacaacacagatgtcagtctatgctctaatgtcaaagaaataaagaaactccatggtctacagtgatataataccaaaggggtttgaggagggactcactgcttccataaaagacagaaatattgtgagtataggccgggcgtggtggctcacgcctgtaatcccagcactttgggaggccaagatgggtggatcacgaggtgaggagatcaagaccatcctggctaacacagtgaaaccccgtctctactaaatatacagaaaattagccgggcgaggtggcgggcacctgtagtcccagctactccggaggctgagacaggagaatggcgtgaacccaggaggcggagcttgcactgagccgagatcgcgccactgcactccagcctaggcgactgagcgagactctgtctcaaaaaaagaaaaaaaaagaaagaaatattgcgagtatatagtgactacagcaaggctctttaacaataaggaaggagaatgaagaagtattcacaatctgaagtggaaaaatgacaaaaagcaacaagtaaatggatgaactaaaccatctgaggaattaaattatgaagagtgtgtctctacaatttaaaaaaaatgttctatttctgagatcaggtaaacattcaggtttaattataatgaccacagtgtaaactcaggtctagaatgtaacagtatgctacaagtgatttcgttagagtgaaactggtctgacaaagaagatgctaacagtaggttcttggtctgcatttagtttttcttttttaaagactggtaaatagcaaacgaaatttatgtatgaaatacaactaacagaagctattatgaaaactcatccagaagaaaaacattcacctgaggattacattactataatctatatgaatctttaatctgcatgcatcttacagccgaatggttctcggagcactacctaaaccacaaaactggttggccagccctgaagaagagcttactcatgctgctcgaacagaagtcgcatatgcccttccctgagatcacagctctactgtccagacatgcattcaagaaacaacaagcaaaatcatctgggccattcaagacaccggaatgaacagaaatcagatacaaacacacgtctagctttttcaaataatagtggatatacaaggcattttaaactggcaatggcaaagactataattttctgctgagggatattatcacaattttccaacctaggtttgaaccaaggcttataagagccctcctccttaatgcaacatcacacccagtactttgctatgacattctatacagcagattataaccctgactctcaggctttttggagttaatcatttcaaaagagagtgagttggacacattaaattaacatggcaaactagagtggtttctttccattcccatccccatatggtcttctttttcaaaggaggacaaacatttgaaaaaattatttcagagttctaaaatgactctgacaagctactattaataactcttgatcctttggatcaatacgaaacacagttaggtaaaagggaaaacaaagaaggctagatgtgctaatgaaggcataagaaaacaaatcagtgacccaggcaataaaagcctgaaaaatattatctttatatatgatagtgaataaatcaaatttttctgtagtgttacttataactttatttttatttcagtgtttgaagaaaaggtaatgacagtatttgataagttataatctggatcctattttaccaattgtttttaaacatttttagtgactaaaatgatatctccgactctaccatgtgctttcacaaaccacaggtatcttctggtagattgcaaatggatgtcccttcttcttttaaaatgtaccttaaaagatatggttaaattttcctctttcgtcaataactttcagaatacacatgctattcaagagtgccaaatgaatctgtgaaaaggaaaatatactacatggaggctgattagacaaggacaaagctaatcaaaattgatttggccaagttgaagcctgcttcctctttttagctataatgggaggagtgagagggagtagattctttttcaagggacatcttaaggttgaaagctggtatcacaaaacatacagcatgataaatatcttaactaaaaattgctaacaagggcctttgtgatttcttttgtaagactacacagcataagaagtgtgatgaagaagaacgagaggaagatggaggagaaaaccagtaagatgacggttatctgcagaaaagattgttttttcaaacacaattttaaaagtcttcctttctaaactccacatctgtctgccacttttcaccagagaattaagcaaaggcatcactcctcagtagaagaacatttttagttatctggaaatataacttcatggacgtacaataattatatctagtaactttaagaaaaactctagctgtgatctgacattaaactgggctcccagggtctaaatgggcttttgccaaaaattaacaatggtgaaacaacttacttttgcactctagccaaacaaaaataataaaaccatagtctcaatttctctttaataaactaaatttagattacacctttaaaataagctttgacataaatggctttaaaataacaagaacatctaacatttgggtcttttcccagttaattatttgctggcattagactcgaaattccttggcttcaccttaagttgacactcccaagtgctaattaggaaactatatacattattaaccagagaatgttgtgcttaaaacatgcatattacatatgtatcttcttattaatgttattcctttcacttctcaaaatacctctttagaaaatagagctcctatttccatgaagcaattggtggctcgtgagggaattcctgtcaaaatgcaattaatagaaaggggccaagatgacacaggatacttgtcttggaaacatccttaacatgagtcaaatttaatctcactgaaatagtggagagaaatgttaatgactgcagatgtcacacattttactcatactaggtgattcccaaagaaaatggctaactcatgtatgaactaaaccactaccaaggaaccacacatgtcagggagtacaaggccgagacatgcctttctccaatactatctcttccaaaaagccacaggacagatgggaaaataaatgcaggtaaacaaggtagacctaatgatttcctaattaggaagatgtgatcttctcattaattgtcaagttaatggaccacaatagcagtttcataaattgagtccagtaatccaagctttggtgtctctagtccacagaattctcctcatacttccagacccttcatccagccacaaagttgtcagttctgcttgatttgtttcaatactgtactcgacgacagctgtcggaaacagtacattagaacagctgctatgacagctacaaggggcttggaagtttaattaggctcattgtgacattgtgcatttttctaaacacggaatgatccacaaaaataaagaaattttgagtgggtctgaacaatgtttacttattggcaccaccaactggttaacctcagtttgagttatatccttggtctcataatatctttgctaccaggctgataagaggtataaaaaaataaataaacaggaggagcagttagatgcacaagaaaaggggcattaaaacggagaggaaatggtgaggaagtcacgtcaataatctctttcaaaggctggctggtagccaaggaggatcccgcagtgtctcaggatttacttccaaaggaaatgtattcagaggccctgagcctggtgccaactgcaaacaaaaccactcattatggtcacagccccctagagaaggggagaatggcttactctcagcatccgtgcggaggaagaaagtgaggagcagcagcagcagcctggctacgtgcaccatcctgcagcttggcagcagcgtgcgcgagcagcttggaatcactgcctccggagccgcagcgagtctgtccgatctgaaatttcagctggaacactttcagagc
